United States Patent
Gori et al.

(10) Patent No.: US 12,031,132 B2
(45) Date of Patent: Jul. 9, 2024

(54) SYSTEMS AND METHODS FOR THE TREATMENT OF HEMOGLOBINOPATHIES

(71) Applicant: EDITAS MEDICINE, INC., Cambridge, MA (US)

(72) Inventors: Jennifer Leah Gori, Jamaica Plain, MA (US); Edouard Aupepin De Lamothe-Dreuzy, Boston, MA (US); Jack Heath, Winchester, MA (US); John Anthony Zuris, Boston, MA (US); KaiHsin Chang, Medfield, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 112 days.

(21) Appl. No.: 17/019,154

(22) Filed: Sep. 11, 2020

(65) Prior Publication Data

US 2021/0254061 A1 Aug. 19, 2021

Related U.S. Application Data

(63) Continuation of application No. PCT/US2019/022374, filed on Mar. 14, 2019.

(60) Provisional application No. 62/773,073, filed on Nov. 29, 2018, provisional application No. 62/767,488, filed on Nov. 14, 2018, provisional application No. 62/643,168, filed on Mar. 14, 2018.

(51) Int. Cl.
*C12N 15/113* (2010.01)
*A61K 9/00* (2006.01)

(52) U.S. Cl.
CPC .......... *C12N 15/113* (2013.01); *A61K 9/0009* (2013.01); *C12N 2310/313* (2013.01)

(58) Field of Classification Search
None
See application file for complete search history.

(56) References Cited

U.S. PATENT DOCUMENTS

| | | |
|---|---|---|
| 6,413,540 B1 | 7/2002 | Yaacobi |
| 6,586,240 B1 | 7/2003 | Singer et al. |
| 8,697,359 B1 | 4/2014 | Zhang |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,394 B2 | 11/2014 | Chalasani et al. |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 9,322,037 B2 | 4/2016 | Liu et al. |
| 9,499,847 B2 | 11/2016 | Porter et al. |
| 2003/0186238 A1 | 10/2003 | Allawi et al. |
| 2007/0020627 A1 | 1/2007 | Barbas |
| 2010/0055793 A1 | 3/2010 | Chandrasegaran et al. |
| 2010/0055798 A1 | 3/2010 | Battersby |
| 2010/0076057 A1 | 3/2010 | Sontheimer et al. |
| 2011/0059502 A1 | 3/2011 | Chalasani |
| 2011/0189776 A1 | 8/2011 | Terns et al. |
| 2011/0223638 A1 | 9/2011 | Wiedenheft et al. |
| 2011/0236894 A1 | 9/2011 | Rao et al. |
| 2011/0301073 A1 | 12/2011 | Gregory et al. |
| 2012/0270273 A1 | 10/2012 | Zhang et al. |
| 2013/0130248 A1 | 5/2013 | Haurwitz et al. |
| 2013/0253040 A1 | 9/2013 | Miller et al. |
| 2014/0068797 A1 | 3/2014 | Doudna et al. |
| 2014/0179770 A1 | 6/2014 | Zhang et al. |
| 2014/0242699 A1 | 8/2014 | Zhang |
| 2014/0309177 A1 | 10/2014 | Perez-Pinera et al. |
| 2014/0315985 A1 | 10/2014 | May et al. |
| 2014/0335620 A1 | 11/2014 | Zhang et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356958 A1 | 12/2014 | Mali et al. |
| 2015/0056705 A1 | 2/2015 | Conway et al. |
| 2015/0132269 A1 | 5/2015 | Orkin et al. |
| 2015/0232833 A1 | 8/2015 | Mali et al. |
| 2015/0259704 A1 | 9/2015 | Church et al. |
| 2016/0153005 A1 | 6/2016 | Zhang et al. |

(Continued)

FOREIGN PATENT DOCUMENTS

| | | |
|---|---|---|
| WO | 2002/089767 A1 | 11/2002 |
| WO | 2003/072788 A1 | 9/2003 |

(Continued)

OTHER PUBLICATIONS

Kim, D., et al., "Genome-wide analysis reveals specificities of Cpf1 endonucleases in human cells," Nat. Biotechnol. 34(8):863-868 (2016).
Kleinstiver, B.P., et al., "Genome-Wide Specificities of CRISPR-Cas Cpf1 Nucleases in Human Cells," Nat. Biotechnol. 34(8):869-874 (2016).
Sakuma, T., et al., "Multiplex Genome Engineering in Human Cells Using All-in-One CRISPR/Cas9 Vector System," Sci. Rep. 4(5400):1-6 (2014).
Ahern, E.J., et al., "The Prevalence of the Rarer Inherited Haemoglobin (Continued)

*Primary Examiner* — Brian Whiteman
(74) *Attorney, Agent, or Firm* — Perkins Coie LLP; Courtney Prochnow

(57) ABSTRACT

Genome editing systems, guide RNAs, and CRISPR-mediated methods are provided for altering portions of the HBG1 and HBG2 loci, portions of the erythroid specific enhancer of the BCL11A gene, or a combination thereof, in cells and increasing expression of fetal hemoglobin.

26 Claims, 98 Drawing Sheets

Specification includes a Sequence Listing.

(56) References Cited

U.S. PATENT DOCUMENTS

| | | | |
|---|---|---|---|
| 2016/0281111 A1 | 9/2016 | Cotta-Ramusino et al. | |
| 2016/0289675 A1* | 10/2016 | Ryan | C12N 9/22 |
| 2016/0324987 A1 | 11/2016 | Wang et al. | |
| 2016/0340661 A1 | 11/2016 | Cong et al. | |
| 2017/0058298 A1 | 3/2017 | Kennedy et al. | |
| 2018/0273609 A1 | 9/2018 | Porteus et al. | |
| 2018/0291370 A1 | 10/2018 | Gersbach et al. | |
| 2019/0010495 A1 | 1/2019 | Boitano et al. | |
| 2019/0241911 A1* | 8/2019 | Dong | C12N 15/113 |
| 2020/0299661 A1* | 9/2020 | Gori | C12Q 1/44 |
| 2020/0299689 A1* | 9/2020 | Lee | C12N 15/113 |

FOREIGN PATENT DOCUMENTS

| | | | |
|---|---|---|---|
| WO | 2008/108989 A2 | 9/2008 | |
| WO | 2010/054108 A9 | 5/2010 | |
| WO | 2011/143124 A2 | 11/2011 | |
| WO | 2011/146121 A1 | 11/2011 | |
| WO | 2012/145601 A2 | 10/2012 | |
| WO | 2012/164565 A8 | 12/2012 | |
| WO | 2013/012674 A1 | 1/2013 | |
| WO | 2013/066438 A2 | 5/2013 | |
| WO | 2013/082519 A2 | 6/2013 | |
| WO | 2013/098244 A1 | 7/2013 | |
| WO | 2013/126794 A1 | 8/2013 | |
| WO | 2013/141680 A1 | 9/2013 | |
| WO | 2013/142578 A1 | 9/2013 | |
| WO | 2013/163628 A2 | 10/2013 | |
| WO | 2013/176772 A1 | 11/2013 | |
| WO | 2013/181228 A1 | 12/2013 | |
| WO | 2014/018423 A8 | 1/2014 | |
| WO | 2014/022702 A2 | 2/2014 | |
| WO | 2014/036219 A2 | 3/2014 | |
| WO | 2014/059255 A1 | 4/2014 | |
| WO | 2014/065596 A1 | 5/2014 | |
| WO | 2014/085593 A1 | 6/2014 | |
| WO | 2014/089290 A1 | 6/2014 | |
| WO | 2014/093479 A1 | 6/2014 | |
| WO | 2014/093595 A1 | 6/2014 | |
| WO | 2014/093622 A8 | 6/2014 | |
| WO | 2014/093635 A9 | 6/2014 | |
| WO | 2014/093655 A2 | 6/2014 | |
| WO | 2014/093661 A2 | 6/2014 | |
| WO | 2014/093694 A1 | 6/2014 | |
| WO | 2014/093709 A1 | 6/2014 | |
| WO | 2014/093712 A1 | 6/2014 | |
| WO | 2014/093718 A1 | 6/2014 | |
| WO | 2014/099744 A1 | 6/2014 | |
| WO | 2014/099750 A2 | 6/2014 | |
| WO | 2014/124284 A1 | 8/2014 | |
| WO | 2014/144288 A1 | 9/2014 | |
| WO | 2014/144592 A2 | 9/2014 | |
| WO | 2014/144761 A2 | 9/2014 | |
| WO | 2014/152432 A2 | 9/2014 | |
| WO | 2014/186585 A2 | 11/2014 | |
| WO | 2014/197568 A2 | 12/2014 | |
| WO | 2014/197748 A2 | 12/2014 | |
| WO | 2014/204578 A1 | 12/2014 | |
| WO | 2014/204725 A8 | 12/2014 | |
| WO | 2015/006290 A1 | 1/2015 | |
| WO | 2015/006294 A1 | 1/2015 | |
| WO | 2015/006498 A2 | 1/2015 | |
| WO | 2015/013583 A8 | 1/2015 | |
| WO | 2015/021353 A1 | 2/2015 | |
| WO | 2015/027134 A1 | 2/2015 | |
| WO | 2015/035136 A8 | 3/2015 | |
| WO | 2015/035139 A2 | 3/2015 | |
| WO | 2015/035162 A2 | 3/2015 | |
| WO | 2015/048577 A2 | 4/2015 | |
| WO | 2015/048690 A1 | 4/2015 | |
| WO | 2015/070083 A1 | 5/2015 | |
| WO | 2015/071474 A9 | 5/2015 | |
| WO | 2015/077290 A2 | 5/2015 | |
| WO | 2015/077318 A1 | 5/2015 | |
| WO | 2015/089406 A1 | 6/2015 | |
| WO | 2015/089462 A1 | 6/2015 | |
| WO | 2015/099850 A1 | 7/2015 | |
| WO | 2015/138510 A8 | 9/2015 | |
| WO | 2015/148860 | 10/2015 | |
| WO | 2015/148863 A2 | 10/2015 | |
| WO | 2015/188056 A1 | 12/2015 | |
| WO | 2015/195621 A1 | 12/2015 | |
| WO | 2016/011080 A2 | 1/2016 | |
| WO | 2016/022363 A9 | 2/2016 | |
| WO | 2016/073990 A2 | 5/2016 | |
| WO | 2016/094872 A1 | 6/2016 | |
| WO | 2016/135557 A2 | 9/2016 | |
| WO | 2016/135558 A2 | 9/2016 | |
| WO | 2016/182959 A1 | 11/2016 | |
| WO | 2016/186772 A2 | 11/2016 | |
| WO | 2016/205613 A1 | 12/2016 | |
| WO | 2016/205749 A1 | 12/2016 | |
| WO | 2017/035416 A2 | 3/2017 | |
| WO | 2017/077394 A2 | 5/2017 | |
| WO | 2017/106657 A1 | 6/2017 | |
| WO | WO-2017106657 A1 * | 6/2017 | C12N 15/102 |
| WO | 2017/160890 A1 | 9/2017 | |
| WO | 2017/184768 | 10/2017 | |
| WO | 2017/191503 A1 | 11/2017 | |
| WO | 2018/017754 A1 | 1/2018 | |
| WO | 2018/126176 A1 | 7/2018 | |
| WO | 2018/142364 A1 | 8/2018 | |
| WO | 2018/170184 A1 | 9/2018 | |
| WO | 2018/209158 A2 | 11/2018 | |
| WO | 2019/118516 A1 | 6/2019 | |
| WO | WO-2019118516 A1 * | 6/2019 | A61K 35/17 |
| WO | 2019/178416 A1 | 9/2019 | |
| WO | 2019/178426 A1 | 9/2019 | |
| WO | 2021/119040 A1 | 6/2021 | |

OTHER PUBLICATIONS

Defects in Adult Jamaicans," Br. J. Haematol. 25(4):437-444 (1973).
Akinbami, A.O., et al., "Hereditary Persistence of Fetal Hemoglobin Caused by Single Nucleotide Promoter Mutations in Sickle Cell Trait and Hb SC Disease," Hemoglobin 40(1):64-65 (2016).
Al-Attar, S., et al., "Clustered Regularly Interspaced Short Palindromic Repeats (CRISPRs): The Hallmark of an Ingenious Antiviral Defense Mechanism in Prokaryotes," Biol. Chem. 392:277-289 (2011).
Aliyu, Z.Y., et al., "Sickle Cell Disease and Pulmonary Hypertension in Africa: A Global Perspective and Review of Epidemiology, Pathophysiology, and Management," Am. J. Hematol. 83(1):63-70 (2008).
Altschul, S. F., et al., "Gapped BLAST and PSI-BLAST: A New Generation of Protein Database Search Programs," Nucleic Acids Res. 25(17):3389-3402 (1997).
Altschul, S. F., et al., "Basic Local Alignment Search Tool," J. Mol. Biol. 215(3):403-410 (1990).
Amrani, N., et al., "NmeCas9 is an Intrinsically High-Fidelity Genome-Editing Platform," Genome Biol. 19:214 (2018).
Anders, C., et al., "Structural Basis of PAM-Dependent Target DNA Recognition by the Cas9 Endonuclease," Nature 513(7519):569-573 (2014).
Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).
Angastiniotis, M., et al., "Global Epidemiology of Hemoglobin Disorders," Ann. N.Y. Acad. Sci. 850:251-269 (1998).
Anonymous, Third Party Observation for EP13818570.7, Oct. 1, 2014, 15 pages.
Anonymous, Third Party Observation for EP13824232.6, Sep. 8. 2014, 48 pages.
Anonymous, Third Party Observation for EP13824232.6, Sep. 22, 2014, 19 pages.
Anonymous, Third Party Observation for EP13824232.6, Oct. 22, 2014, 7 pages.
Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).

(56) References Cited

OTHER PUBLICATIONS

Baker, M., "Gene Editing at CRISPR Speed," Nat. Biotechnol. 32(4):309-312 (2014).
Barbosa, C.G., et al., "Promoter Region Sequence Differences in the A and G Gamma Globin Genes of Brazilian Sickle Cell Anemia Patients," Braz. J. Med. Biol. Res. 43(8):705-711 (2010).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in *Drosophila*," J. Genet. Genom. 41:7-19 (2014).
Bauer, D. E., et al., "An Erythroid Enhancer of BCL11A Subject to Genetic Variation Determines Fetal Hemoglobin Level," Science 342(6155):253-257 (2013).
Beerli, R. R., et al., "Toward Controlling Gene Expresion at Will: Specific Regulation of the erbB-2/HER-2 Promoter by Using Polydactyl Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15):7429-7437 (2013).
Bitinaite, J., et al., "FokI Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Bothmer, A, et al., "Characterization of the Interplay Between DNA Repair and CRISPR/Cas9-Induced DNA Lesions at an Endogenous Locus," Nat. Commun. 8:13905 (2017).
Bothmer, A., et al., "Detection and Modulation of DNA Translocations During Multi-Gene Genome Editing in T Cells," The CRISPR Journal 3(3): 177-187 (2020).
Bouva, M. J., et al., "Known and New Delta Globin Gene Mutations and Their Diagnostic Significance," Haematologica 91(1):129-132 (2006).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, dated Nov. 24, 2014, 5 pages.
Broad Institute, Information Disclosure Statement submitted for U.S. Appl. No. 14/256,912, citing Electronic Mail from T. Kowalski which references Briner et al., Nov. 3, 2014, 8 pages.
Broad Institute, Request for Oral Examination for EP13818570.7, dated Oct. 27, 2014, 3 pages.
Broad Institute, Response to EP Examination Report for EP13824232.6, dated Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brousseau, D.C., et al., "The Number of People with Sickle-Cell Disease in the United States: National and State Estimates," Am. J. Hematol. 85(1):77-78 (2010).
Brummelkamp, T. R., et al., "A System for Stable Expression of Short Interfering RNAs in Mammalian Cells," Science 296(5567):550-553 (2002).
Burstein, D., et al., "New CRISPR-Cas Systems from Uncultivated Microbes," Nature 542(7640):237-241 (2017).
Caldecott, K.W., "Single-Strand Break Repair and Genetic Disease," Nat. Rev. Genet. 9(8):619-631 (2008).
Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Canver, M. C., et al., "BCL11A Enancer Dissection by Cas9-Mediated In Situ Saturating Mutagenesis," Nature 527(7577):192-197 (2015).
Carroll, D., "A CRISPR Approach to Gene Targeting," Mol. Ther. 20(9):1658-1660 (2012).
Cassini, A., et al., "A Highly Specific SpCas9 Variant is Identified by In Vivo Screening in Yeast," Nat. Biotechnol. 36(3):265-271 (2018).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chandrakasan, S., et al., "Gene Therapy for Hemoglobinopathies: The State of the Field and the Future," Hematol. Oncol. Clin. North Am. 28(2):199-216 (2014).
Chang, K.H., et al., "Long-Term Engraftment and Fetal Globin Induction upon BCL11A Gene Editing in Bone-Marrow-Derived CD34+ Hematopoietic Stem and Progenitor Cells," Mol. Ther. Methods Clin. Dev. 4:137-148 (2017).
Chassanidis, C., et al., "The Hellenic Type of Nondeletional Hereditary Persistence of Fetal Hemoglobin Results from a Novel Mutation (g.-109G>T) in the HBG2 Gene Promoter," Ann. Hematol. 88(6):549-555 (2009).
Chen, X., et al., "Fusion Protein Linkers: Property, Design and Functionality," Adv. Drug Deliv. Rev. 65(10):1357-1369 (2013).
Chen, F., et al., "Targeted Activation of Diverse CRISPR-Cas Systems for Mammalian Genome Editing Via Proximal CRISPR Targeting," Nat. Commun. 8:14958 (2017).
Chen, J. S., et al., "Enhanced Proofreading Governs CRISPR-Cas9 Targeting Accuracy," Nature 550(7676):407-410 (2017).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5):726-737 (2013).
Cong, L., et al., "Multiplex Genome Engineering Using CRISPR/Cas Systems," Science 339(6121):819-823 (2013).
Cong, L et al., "Supplementary Material: Multiplex Genome Engineering Using CRISPR-Cas Systems," Science Express (Jul. 5, 2012).
Cong, L. et al., "Supplementary Material: Multiplex Genome Engineering Using CRISPR-Cas Systems," Science Express (Jan. 3, 2013).
Cornish-Bowden, A., "Nomenclature for Incompletely Specified Bases in Nucleic Acid Sequences: Recommendations 1984," Nucleic Acids Res. 13(9):3021-3030 (1985).
Cost, G. J., et al., Geneseq Accession No. BBD49192 (2014), 2 pages.
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Cramer, M. L., et al., "Induction of T-Cell Infiltration and Programmed Death Ligand 2 Expression by Adeno-Associated Virus in

(56) References Cited

OTHER PUBLICATIONS

Rhesus Macaque Skeletal Muscle and Modulation by Prednisone," Hum. Gene Ther. 28(6):493-509 (2017).

Datsenko, K. A., et al., "Molecular Memory of Prior Infections Activates the CRISPR/Cas Adaptive Bacterial Immunity System," Nat. Commun. 3:945 (2012).

Davis, L., et al., "Homology-Directed Repair of DNA Nicks Via Pathways Distinct from Canonical Double-Strand Break Repair," PNAS 111(10):E924-932 (2014).

Deltcheva, E., et al., CRISPR RNA Maturation by Trans-Encoded Small RNA and Host Factor RNase III, Nature 471:602-607 (2011).

Deltcheva, E., et al., Supplementary Figures: CRISPR RNA Maturation by Trans-Encoded Small RNA and Host Factor RNase III. Downloaded from www.nature.com/nature, p. 1-35, 2011.

Deveau, H., et al., "Phage Response to CRISPR-Encoded Resistance in *Streptococcus thermophilus*," J. Bacteriol. 190(4):1390-1400 (2008).

Dever, D. P., et al., "CRISPR/Cas9 Beta-Globin Gene Targeting in Human Haematopoietic Stem Cells," Nature 539:384-389 (2016).

DiCarlo, J. E., et al., "Genome Engineering in *Saccharomyces cerevisiae* Using CRISPR-Cas Systems," Nucl. Acids Res. 41(7):4336-43 (2013).

Ding, Q., et al., "Enhanced Efficiency of Human Pluripotent Stem Cell Genme Editing through Replacing TALENs with CRIPSRs," Cell Stem Cell 12:393-394 (2013).

Dingwall, C., et al., "A Polypeptide Domain That Specifies Migration of Nucleoplasmin Into the Nucleus," Cell 30:449-458 (1982).

Dreszer, T. R., et al., "The UCSC Genome Browser Database: Extensions and Updates 2011," Nucl. Acids Res. 40:D918-D923 (2012).

Esvelt, K.M., et al., "A System for the Continuous Directed Evolution of Biomolecules," Nature 472(7344):499-503 (2011).

Esvelt, K. M., et al., "Orthogonal Cas9 Proteins for RNA-Guided Gene Regulation and Editing," Nat. Methods 10(11):1116-1121 (2013).

Fine, E.J., et al., "Trans-Spliced Cas9 Allows Cleavage of HBB and CCR5 Genes in Human Cells Using Compact Expression Cassettes," Sci. Rep. 5:10777 (2015).

Fonfara, I., et al., "Phylogeny of Cas9 Determines Functional Exchangeability of Dual-RNA and Cas9 Among Orthologous Type II CRISPR- Cas Systems," Nucl. Acids Res.42(4):2577-2590 (2014).

Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).

Frit, P., et al., "Alternative End-Joining Pathway(s): Bricolage at DNA Breaks," DNA Repair (Amst) 17:81-97 (2014).

Fu, Y., et al., "High-Frequency Off-Target Mutagenesis Induced by CRISPR-Cas Nucleases in Human Cells," Nat. Biotechnol. 31:822-826 (2013).

Fu, Y., et al., "Targeted Genome Editing in Human Cells Using CRISPR/Cas Nucleases and Truncated Guide RNAs," Methods Enzymol. 546:21-45 (2014).

Fu, Y., et al., "Improving CRISPR-Cas Nuclease Specificity Using Truncated Guide RNAs," Nat. Biotechnol. 32(3):279-284 (2014).

Fu, B. X. H., et al., "Landscape of Target: Guide Homology Effects on Cas9-Mediated Cleavage," Nucl. Acids Res. 42(22):13778-13787 (2014).

Gabriel, R., et al., "An Unbiased Genome-Wide Analysis of Zinc-Finger Nuclease Specificity," Nat. Biotechnol. 29:816-823 (2011).

Gao, L., et al., "Engineered Cpf1 Variants with Altered PAM Specificities Increase Genome Targeting Range," Nat. Biotechnol. 35(8):789-792 (2017).

Garneau, J. E., et al., "The CRISPR-Cas Bacterial Immune Systems Cleaves Bacteriophage and Plasmid DNA," Nature 468:67-71 (2010).

Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).

Giannoukos, G., et al., "UDiTaS™, a genome editing detection method for indels and genome rearrangements," BMC Genomics 19:212 (2018).

Giarratana, M. C., et al., "Ex vivo generation of fully mature human red blood cells from hematopoietic stem cells," Nat. Biotechnol. 23(1):69-74 (2005).

Giarratana, M. C., et al., "Proof of Principle for Transfusion of In Vitro-Generated Red Blood Cells," Blood 118(19):5071-5079 (2011).

Gilbert, L. A., et al., "CRISPR-Mediated Modular RNA-Guided Regulation of Transcription in Eukaryotes," Cell 154(2):442-451 (2013).

Goldfarb, D. S., et al., "Synthetic Peptides as Nuclear Localization Signals," Nature 322:641-644 (1986).

Gratz, S. J., et al., "Genome Engineering of *Drosophila* with the CRISPR RNA-Guided Cas9 Nuclease," Genetics 194(4):1029-1035 (2013).

Grieger, J. C., et al., "Production and Characterization of Adeno-Associated Viral Vectors," Nat. Protoc. 1(3):1412-1428 (2006).

Guilinger, J. P., et al., "Fusion of Catalytically Inactive Cas9 to FokI Nuclease Improves the Specificity of Genome Modification," Nat Biotechnol. 32(6):577-583 (2014).

Guo, X., et al., "RNA-Dependent Folding and Stabilization of C5 Protein During Assembly of the *E. coli* Rnase P Holoenzyme," J. Mol. Biol. 360:190-203 (2006).

Guo, Q., et al., "'Cold shock' increases the frequency of homology directed repair gene editing in induced pluripotent stem cells," Sci. Rep. 8(1):2080 (2018).

Gustafsson, C., et al., "Codon Bias and Heterologous Protein Expression," Trends Biotechnol. 22(7):346-353 (2004).

Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).

Hale, C. R., et al., "Essential Features and Rational Design of CRISPR RNAs That Function With the Cas RAMP Module Complex to Cleave RNAs," Mol. Cell 45(3):292-302 (2012).

Hatoum-Aslan, A., et al. "Mature Clustered Regularly Interspaced, Short Palindromic Repeats RNA 5,9,14 (crRNA) Length is Measured by a Ruler Mechanism Anchored at the Precursor Processing Site," Proc. Natl. Acad. Sci. 108(52):21218-21222 (2011).

Heigwer, F., et al., "E-CRISP: Fast CRISPR Target Site Identification," Nat. Methods 11(2):122-123 (2014).

Heintze, J., et al., "A Crispr CASe for High-Throughput Silencing," Front. Genet. 4(193):1-6 (2013).

Hinz, J. M., et al., "Nucleosomes Selectively Inhibit Cas9 Off-Target Activity at a Site Located at the Nucleosome Edge," J. Biol. Chem. 291(48):24851-24856 (2016).

Hoban, M. D., et al., "A genome editing primer for the hematologist," Blood 127(21):2525-2535 (2016).

Hockemeyer, D., et al., "Efficient Targeting of Expressed and Silent Genes in Human ESCs and iPSCs Using Zinc-Finger Nucleases," Nat. Biotechnol. 27(9):851-857 (2009).

Hockemeyer, D., et al., "Genetic Engineering of Human luripotent Cells Using TALE Nucleases," Nat. Biotechnol. 29:731-734 (2011).

Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).

Horvath, P., et al., "CRISPR/Cas, The Immune System of Bacteria and Archaea," Science 327(5962):167-170 (2010).

Horvath, P., et al., "RNA-Guided Genome Editing A La Carte," Cell Res. 23:733-734 (2013).

Hou, Z, et al., "Efficient Genome Engineering in Human Pluripotent Stem Cells Using Cas9 from Neisseria Meningitidis," Proc. Natl. Acad. Sci. U.S.A. 110(39):15644-15649 (2013).

Hsu, P.D., et al., "DNA Targeting Specificity of RNA-Guided Cas9 Nucleases," Nat. Biotechnol. 31(9):827-832 (2013).

Hu, X., "CRISPR/Cas9 System and Its Applications in Human Hematopoietic Cells," Blood Cells, Molecules & Diseases 62:6-12 (2016).

Huang, X., et al., "Production of Gene-Corrected Adult Beta Globin Protein in Human Erythrocytes Differentiated from Patient iPSCs After Genome Editing of the Sickle Point Mutation," Stem Cells 33:1470-1479 (2015).

(56) References Cited

OTHER PUBLICATIONS

Hwang, W. Y., et al., "Heritable and Precise Zebrafish Genome Editing Using a CRISPR-Cas System," PLoS One 8(7):e68708 (2013).
Hwang, W. Y., et al., "Efficient Genome Editing in Zebrafish Using a CRISPR-Cas System," Nat. Biotechnol. 31(3):227-229 (2013).
Hyun, P. S., et al., "Therapeutic CRISPR/Cas9 Genome Editing for Treating Sickle Cell Disease," Blood 128(22):4703 (2016).
Iyama, T., et al., "DNA Repair Mechanisms in Dividing and Non-Dividing Cells," DNA Repair (Amst.) 12(8):620-636 (2013).
Iyer, L. M., et al., "Prediction of Novel Families of Enzymes Involved in Oxidative and Other Complex Modifications of Bases in Nucleic Acids," Cell Cycle 8(11):1698-1710 (2009).
Jiang, W., et al., "RNA-Guided Editing of Bacterial Genomes Using CRISPR-Cas Systems," Nat. Biotechnol. 31(3):233-239 (2013).
Jinek, M., et al., "A Programmable Dual-RNA-Guided DNA Endonuclease in Adaptive Bacterial Immunity," Science 337(6096):816-821 (2012).
Jinek, M., et al., "Structures of Cas9 Endonucleases Reveal RNA-Mediated Conformational Activation," Science 343(6176):1247997 (2014).
Jinek, M., et al., "RNA-Programmed Genome Editing in Human Cells," eLife 2:e00471 (2013).
Joung, J., et al., "Genome-Scale CRISPR-Cas9 Knockout and Transcriptional Activation Screening," Nat. Protoc. 12(4):828-863 (2017).
Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.
Karolchik, D., et al., "The UCSC Table Browser Data Retrieval Tool," Nucleic Acids Research 32:D493-496 (2004).
Karvelis, T., et al., "crRNA and tracrRNA Guide Cas9-Mediated DNA Interference in Streptococcus thermophilus," RNA Biol. 10(5):841-851 (2013).
Kent, W. J., et al., "The Human Genome Browser at UCSC," Genome Research 12:996-1006 (2002).
Keryer-Bibens, C., et al., "Tethering of Proteins to RNAs by Bacteriophage Proteins," Biol. Cell, 100:125-138 (2008).
Khalil, A. S., et al., "Synthetic Biology: Applications Come of Age," Nat. Rev. Genet. 11(5):367-379 (2010).
Kim, H.S., et al., "Problems Encountered in Detecting a Targeted Gene by the Polymerase Chain Reaction," Gene 103:227-233 (1991).
Kim, Y.G., et al., "Hybrid Restriction Enzymes: Zinc Finger Fusions to Fok I Cleavage Domain," Proc. Natl. Acad. Sci. USA 93:1156-1160 (1996).
Kim, E., et al., "In Vivo Genome Editing with a Small Cas9 Orthologue Derived from Campylobacter Jejuni," Nat. Commun. 8:14500 (2017).
King, N. M.P., et al., "En Route to Ethical Recommendations for Gene Transfer Clinical Trials," Mol. Ther. 16(3):432-438 (2008).
Kleinstiver, B.P., et al., "Broadening the Targeting Range of Staphylococcus aureus CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).
Kleinstiver, B.P., et al., "High-Fidelity CRISPR-Cas9 Nucleases with No Detectable Genome-Wide Off-Target Effects," Nature 529(7587):490-495 (2016).
Kleinstiver, B. P., et al., "Engineered CRISPR-Cas12a variants with increased activities and improved targeting ranges for gene, epigenetic and base editing," Nat. Biotechnol. 37(3):276-282 (2019).
Koike-Yusa, H., et al., "Genome-Wide Recessive Genetic Screening in Mammalian Cells with a Lentiviral CRISPR-Guide RNA Library," Nat. Biotechnol. 32(3):267-273 (2014).
Komor, A.C., et al., "Programmable Editing of a Target Base in Genomic DNA Without Double-Stranded DNA Cleavage," Nature 533(7603):420-424 (2016).

Kosicki, M., et al., "Repair of Double-Strand Breaks Induced by CRISPR-Cas9 Leads to Large Deletions and Complex Rearrangements," Nat. Biotechnol. 36(8):765-771 (2018).
Kosuri, S., et al., "A Scalable Gene Synthesis Platform Using High-Fidelity DNA Microchips," Nat. Biotechnol. 28(12):1295-1299 (2010).
Krieg, A. M., et al., GeneSeq Accession No. BAY71542 (2013).
Kumar, S. R.P., et al., "Clinical development of gene therapy: results and lessons from recent successes," Mol. Ther. Methods Clin. Dev. 3:16034 (2016).
Kurita, R., et al., "Establishment of Immortalized Human Erythroid Progenitor Cell Lines Able to Produce Enucleated Red Blood Cells," PLoS One 8(3):e59890 (2013).
Lambowitz, A. M., et al., "Group II Introns: Mobile Ribozymes that Invade DNA," Cold Spring Harb. Perspect. Biol. 3:a003616 (2011).
Langmead, B., et al., "Ultrafast and Memory-Efficient Alignment of Short DNA Sequences to the Human Genome," Genome Biology 10(3):R25 (2009).
Lederer, C. W., et al., "Beta Testing: Preclinical Genome Editing in Beta-Globin Disorders," Cell Gene Therapeutic Insights 1(2):231-242 (2015).
Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Lee, J. K., et al., "Directed evolution of CRISPR-Cas9 to Increase Its Specificity," Nat. Commun. 9:3048 (2018).
Li, G.M., "Mechanisms and Functions of DNA Mismatch Repair," Cell Res. 18(1):85-98 (2008).
Li, T., et al., "TAL Nucleases (TALNs): Hybrid Proteins Composed of TAL Effectors and FokI DNA-Cleavage Domain," Nucl. Acids Res.39(1): 359-372 (2011).
Li, H., et al., "In Vivo Genome Editing Restores Hemostasis in a Mouse Model of Hemophilia," Nature 475(7355):217-221 (2011).
Li, T., et al., "Modularly Assembled Designer TAL Effector Nucleases for Targeted Gene Knockout and Gene Replacement in Eukaryotes," Nucl. Acids Res. 39(14):6315-6325 (2011).
Liang, P., et al., "CRISPR/Cas9-Mediated Gene Editing in Human Tripronuclear Zygotes," Protein Cell 6(5):363-372 (2015).
Lidonnici, M. R., et al., "Gene Therapy and Gene Editing Strategies for Hemoglobinopathies," Blood Cells, Molecules & Diseases 70:87-101 (2018).
Lombardo, A, et al., "Gene Editing in Human Stem Cells Using Xinc Finger Nucleases and Integrase-Defective Lentiviral Vector Delivery," Nat. Biotechnol. 25(11):1298-1306 (2007).
Lorenz R., et al., "ViennaRNA Package 2.0," Algorithms for Molecular Biology 6:26 (2011).
Maeder, M. L., et al., "CRISPR RNA-Guided Activation of Endogenous Human Genes," Nat. Methods 10:977-979 (2013).
Maeder, M. L., et al., "Rapid "Open-Source" Engineering of Customized Zinc-Finger Nucleases for Highly Efficient Gene Modification," Mol. Cell 31(2):294-301 (2008).
Makarova, K. S., et al., "A Putative RNA-Interference-Based Immune System in Prokaryotes: Computational Analysis of the Predicted Enzymatic Machinery, Functional Analogies with Eukaryotic RNAi, and Hypothetical Mechanisms of Action," Biol. Direct. 1:7 (2006).
Makarova, K. S., et al., "Unification of Cas Protein Families and a Simple Scenario for the Origin and Evolution of CRISPR-Cas Systems," Biol. Direct 6:38 (2011).
Makarova, K.S., et al., "Evolution and Classification of the CRISPR-Cas Systems," Nat. Rev. Microbiol. 9(6):467-477 (2011).
Mali, P., et al., "CAS9 Transcriptional Activators for Target Specificity Screening and Paired Nickases for Cooperative Genome Engineering," Nat. Biotechnol. 31:833-838 (2013).
Mali, P., et al., "Cas9 as a Versatile Tool for Engineering Biology," Nat. Methods 10(10):957-963 (2013).
Mali, P., et al., "RNA-Guided Human Genome Engineering Via Cas9," Science 339(6121):823-826 (2013).

(56) References Cited

OTHER PUBLICATIONS

Mantovani, R., et al., "The Effects of HPFH Mutations in the Human Gamma-Globin Promoter on Binding of Ubiquitous and Erythroid Specific Nuclear Factors," Nucleic Acids Res. 16(16):7783-7797 (1988).
Marteijn, J.A., et al., "Understanding Nucleotide Excision Repair and Its Role in Cancer and Ageing," Nat. Rev. Mol. Cell Biol. 15(7):465-481 (2014).
Martyn, G.E., et al., "The Regulation of Human Globin Promoters by CCAAT Box Elements and the Recruitment of NF-Y," Biochim. Biophys. Acta 1860(5):525-536 (2017).
Masala, B., et al., "Detection of Globin Chains By Reversed-Phase High-Performance Liquid Chromatography," Methods Enzymol. 231:21-44 (1994).
Mathews, D. H., et al., "Expanded Sequence Dependence of Thermodynamic Parameters Improves Prediction of RNA Secondary Structure," J. Mol. Biol. 288:911-940 (1999).
Metais, J.Y., et al., "Genome Editing of HBG1 and HBG2 to Induce Fetal Hemoglobin," Blood Adv. 3(21):3379-92 (2019).
Miller, J. C., et al., "An Improved Zinc-Finger Nuclease Architecture for Highly Specific Genome Editing," Nat. Biotechnol. 25:778-785 (2007).
Miller, J. C., et al., "A Tale Nuclease Architecture for Efficient Genome Editing," Nat. Biotechnol. 29(2):143-150 (2011).
Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).
Moscou, M. J., et al., "A Simple Cipher Governs DNA Recognition by TAL Effectors," Science 326(5959):1501 (2009).
Mukherjee-Clavin, B., et al., "Current Approaches for Efficient Genetic Editing in Human Pluripotent Stem Cells," Front. Biol. 8(5):461-467 (2013).
Myers, E. W., et al., "Optimal Alignments in Linear Space," Comput. Appl. Biosci. 4(1):11-17 (1988).
Nakamura, Y., et al., "Codon Usage Tabulated From International DNA Sequence Databases: Status for the Year 2000," Nucl. Acids Res. 28(1):292 (2000).
Needleman, S. B., et al., "A General Method Applicable to the Search for Similarities in the Amino Acid Sequence of Two Proteins," J. Mol. Biol. 48(3):443-453 (1970).
Nishimasu, H., et al., "Crystal Structure of Cas9 in Complex with Guide RNA and Target DNA," Cell 156(5):935-949 (2014).
Nishimasu, H., et al., "Crystal Structure of *Staphylococcus aureus* Cas9," Cell 162:1113-1126 (2015).
Nishimasu, H., et al., "Engineered CRISPR-Cas9 Nuclease with Expanded Targeting Space," Science 361(6408):1259-1262 (2018).
Notta, F., et al., "Isolation of Single Human Hematopoietic Stem Cells Capable of Long-Term Multilineage Engraftment," Science 333(6039):218-221 (2011).
Ou, Z, et al., "The Combination of CRISPR/Cas9 and iPSC Technologies in the Gene Therapy of Human Beta-Thalassemia in Mice," Scientific Reports 6(1):32463 (2016).
Paix, A., et al., "Precision Genome Editing Using CRISPR-Cas9 and Linear Repair Templates in C. Elegans," Methods 121-121:86-93 (2017).
Pattanayak, V., et al., "High-Throughput Profiling of Off-Target DNA Cleavage Reveals RNA-Programmed Cas9 Nuclease Specificity," Nat. Biotechnol. 31:839-843 (2013).
Pattanayak, V., et al., "Revealing Off-Target Cleavage Specificities of Zinc-Finger Nucleases by In Vitro Selection," Nat. Methods 8:765-770 (2011).
Patterson, S. S., et al., "Codon Optimization of Bacterial Luciferase (lux) for Expression in Mammalian Cells," J. Ind. Microbio. Biotechnology 32:115-123 (2005).
Pausch, P., et al., "CRISPR-CasΦ from Huge Phages is a Hypercompact Genome Editor," Science ;369(6501):333-337 (2020).
Pearson, W. R., et al., "Improved Tools for Biological Sequence Comparison," Proc. Natl. Acad. Sci. U.S.A. 85(8):2444-2448 (1988).
Pellissier, L. P., et al., "Specific Tools for Targeting and Expression in Muller Glial Cells," Mol. Ther. Methods Clin. Dev. 1:14009 (2014).
Peng, R., et al., "Potential Pitfalls of CRISPR/Cas9-Mediated Genome Editing," FEBS J. 283:1218-1231 (2016).
Perez, E. E., et al., "Establishment of HIV-1 Resistance in CD4+ T Cells by Genome Editing Using Zinc-Finger Nucleases," Nat. Biotechnol. 26:808-816 (2008).
Porteus, M. H., et al., "Gene Targeting Using Zinc Finger Nucleases," Nat. Biotechnol. 23(8):967-973 (2005).
Pougach, K., et al., "Transcription, Processing and Function of CRISPR Cassettes in *Escherichia coli*," Mol. Microbiol. 77(6):1367-1379 (2010).
Pride, D. T., et al., "Analysis of Streptococcal CRISPRs from Human Saliva Reveals Substantial Sequence Diversity Within and Between Subjects Over Time," Genome Res. 21:126-136 (2011).
Purnick, P. E. M., et al., "The Second Wave of Synthetic Biology: From Modules to Systems," Nat. Rev. Mol. Cell Biol. 10(6):410-422 (2009).
Qi, L. S., et al., "Repurposing CRISPR as an RNA-Guided Platform for Sequence-Specific Control of Gene Expression," Cell 152:1173-1183 (2013).
Qi, L., et al., "RNA Processing Enables Predictable Programming of Gene Expression," Nat. Biotechnol. 30(10):1002-1007 (2012).
Quinlan, A. R., et al., "BEDTools: A Flexible Suite of Utilities for Comparing Genomic Features," Bioinformatics 26(6):841-842 (2010).
Ran, F.A., et al., "Double Nicking by RNA-Guided CRISPR Cas9 for Enhanced Genome Editing Specificity," Cell 154(6):1380-1389 (2013).
Ran, F. A., et al., "In Vivo Genome Editing Using *Staphylococcus aureus* Cas9," Nature 520(7546):186-191 (2015).
Rand, T. A., et al., "Argonaute2 Cleaves the Anti-Guide Strand of siRNA During RISC Activation," Cell 123:621-629 (2005).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Recht, M. I., et al., "Monitoring Assembly of Ribonucleoprotein Complexes by Isothermal Titration Calorimetry," Methods in Mol. Biol. 488:117-127 (2008).
Reeks, J., et al., "Structure of a Dimeric Crenarchaeal Cas6 Enzyme with an Atypical Active Site for CRISPR RNA Processing," Biochem. J. 452:223-230 (2013).
Regalado, A., "Who Owns the Biggest Biotech Discovery of the Century?," MIT Technology Review, Dec. 4, 2014, http://www.technologyreview.com/featuredstory/532796/who-owns-the-biggest- - biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Richardson, C. D., et al., "Enhancing Homology-Directed Genome Editing by Catalytically Active and Inactive CRISPR-Cas9 Using Asymmetric Donor DNA," Nat. Biotechnol. 34(3):339-344 (2016).
Sander, J. D., et al., "Zinc Finger Targeter (ZiFiT): An Engineered Zinc Finger/Target Site Design Tool," Nucleic Acids Res. 35:W599-W605 (2007).
Sander, J. D., et al., "ZiFiT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sanjana, N. E., et al., "A Transcription Activator-Like Effector (TALE) Toolbox for Genome Engineering," Nat. Protoc. 7(1):171-192 (2012).

(56) References Cited

OTHER PUBLICATIONS

Sankaran, V. G., et al., "Human Fetal Hemoglobin Expression is Regulated by the Developmental Stage-Specific Repressor BCL11A," Science 322(5909):1839-1842 (2008).
Sapranauskas, R., et al., "The *Streptococcus thermophilus* CRISPR-Cas System Provides Immunity in *Escherichia coli*," Nucl. Acids Res.39:9275-9282 (2011).
Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).
Schramm, L., et al., "Recruitment of RNA Polymerase III to Its Target Promoters," Genes Devel. 16:2593-2620 (2002).
Selleck, W., et al., "Biophysical Characterization and Direct Delivery of S. Pyogenes Cas9 Ribonucleoprotein Complexes," Editas Medicine, Apr. 27, 2015, retrieved from URL http://www.editasmedicine.com/documents/ASGCT_poster_2015_Will.pdf.
Shalem, O., et al., "Genome-Scale CRISPR-Cas9 Knockout Screening in Human Cells," Science 343:84 (2014).
Shanks, P., "Crispr Opportunities . . . For What? And for Whom?," Biopolitical Times, Dec. 4, 2014, http://www.biopoliticaltimes.org/article.php?id=8235.
Sharma, R., et al., "In Vivo Genome Editing of the Albumin Locus as a Platform for Protein Replacement Therapy," Blood 126(15):1777-1784 (2015).
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Shen, B., et al., "Generation of Gene-Modified Mice via Cas9/RNA-Mediated Gene Targeting," Cell Res. 23:720-723 (2013).
Shmakov, S., et al., "Discovery and Functional Characterization of Diverse Class 2 CRISPR-Cas Systems," Mol. Cell 60(3):385-397 (2015).
Smith, C., et al., "Efficient and Allele-Specific Genome Editing of Disease Loci in Human iPSCs," Mol. Ther. 23(3):570-577 (2015).
Smith, T. F., et al., "Comparison of Biosequences," Adv. Appl. Math. 2(4):482-489 (1981).
Sobrevals, L., et al., "AAV Vectors Transduce Hepatocytes In Vivo as Efficiently in Cirrhotic as in Healthy Rat Livers," Gene Ther. 19:411-417 (2012).
Song, B., et al., "Improved Hematopoietic Differentiation Efficiency of Gene-Corrected Beta-Thalassemia Induced Pluripotent Stem Cells by CRISPR/Cas9 System," Stem Cells Devel. 24(9):1053-1065 (2015).
Sontheimer, E., "Project 7: Establishing RNA-Directed DNA Targeting in Eukaryotic Cells; Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).
Strecker, J., et al., "Engineering of CRISPR-Cas 12b for Human Genome Editing," Nat. Commun. 10:212 (2019).
Strohkendl, I., et al., "Kinetic Basis for DNA Target Specificity of CRISPR-Cas12a," Mol Cell. 71(5):816-824 (2018).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37):11270-11281 (2000).
Superti-Furga, G., et al., "The -117 Mutation in Greek HPFH Affects the Binding of Three Nuclear Factors to the CCAAT Region of the Gamma-Globin Gene," EMBO J. 7(10):3099-3107 (1988).
Swarts, D. C., et al., "Cas9 Versus Cas 12a/Cpf1: Structure-Function Comparisons and Implications for Genome Editing," WIREs RNA 9:e1481 (2018).
Szczepek, M., et al., "Structure-Based Redesign of the Dimerization Interface Reduces the Toxicity of Zinc-Finger Nucleases," Nat. Biotechnol. 25:786-793 (2007).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas 12b for Mammalian Genome Engineering," Cell Discov. 4:63 (2018).
Terns, M. P., et al., "CRISPR-based Adaptive Immune Systems," Curr. Opin. Microbiol. 14:321-327 (2011).
Thein, S.L., et al., "Control of Fetal Hemoglobin: New Insights Emerging from Genomics and Clinical Implications," Hum. Mol. Genet. 18(R2):R216-R223 (2009).
Thorpe, S. J., et al., "Immunochemical Estimation of Haemoglobin Types in Red Blood Cells by FACS Analysis," Br. J. Haematol. 87:125-132 (1994).
Thurman, R. E., et al., "The Accessible Chromatin Landscape of the Human Genome," Nature 489(7414):75-82 (2012).
Tolia, N. H., et al., "Slicer and the Argonautes," Nat. Chem. Biol. 3(1):36-43 (2007).
Tolpin, Thomas W., Third Party Observation for EP13793997.1, Jan. 6, 2015, 50 pages.
Traxler, E., et al., "Genome Editing Recreates Hereditary Persistence of Fetal Hemoglobin in Primary Human Erythroblasts," Blood J. 126(23):640 (2015).
Traxler, E. A., et al., "A Genome-Editing Strategy to Treat Beta-Hemoglobinopathies that Recapitulates a Muation Associated with a Benign Genetic Condition," Nat. Med. 22(9):987-990 (2016).
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Tsai, S. Q., et al., "Dimeric CRISPR RNA-Guided Fokl Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Van Der Oost, J., "New Tool for Genome Surgery," Science 336:768-768 (2013).
Van Der Ploeg, J. R., "Analysis of CRISPR in *Streptococcus* Mutans Suggests Frequent Occurrence of Acquired Immunity Against Infection by M102-Like Bacteriophages," Microbiology 155:1966-1976 (2009).
Van Overbeek, M., et al., "DNA Repair Profiling Reveals Nonrandom Outcomes at Cas9-Mediated Breaks," Mol. Cell 63:633-646 (2016).
Vidigal, J. A., et al.,"Rapid and Efficient One-Step Generation of Paired gRNA CRISPR-Cas9 Libraries," Nat. Commun. 6:8083 (2015).
Waber, P.G., et al., "Concordance of a Point Mutation 5' to the A Gamma-Globin Gene with A Gamma Beta + Hereditary Persistence of Fetal Hemoglobin in Greeks," Blood 67(2):551-554 (1986).
Wang, H., et al., "One-Step Generation of Mice Carrying Mutations in Multiple Genes By CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).
Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Wang, J., et al., "xCas9 Expands the Scope of Genome Editing with Reduced Efficiency in Rice," Plant Biotechnol. J. 17:709-711 (2019).
Weber, L., et al., "Editing a y-Globin Repressor Binding Site Restores Fetal Hemoglobin Synthesis and Corrects the Sickle Cell Disease Phenotype," Sci. Adv. 6:eaay9392 (2020).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).

(56) References Cited

OTHER PUBLICATIONS

Wu, Y., et al., "Correction of a Genetic Disease in Mouse via Use of CRISPR-Cas9," Cell Stem Cell 13(6):659-662 (2013).
Wu, Y., et al., "Highly Efficient Therapeutic Gene Editing of Human Hematopoietic Stem Cells," Nat. Med. 25(5):776-783 (2019).
Xiao, A., et al., "CasOT: A Genome-Wide Cas9/gRNA Off-Target Searching Tool," Bioinformatics 30(8):1180-1182 (2014).
Xu, Q., et al., "Design of 240,000 Orthogonal 25mer DNA Barcode Probes," Proc. Natl. Acad. Sci. 106(7):2289-2294 (2009).
Xu, J., et al., "Transcriptional Silencing of {Gamma}-Globin by BCL11A Involves Long-Range Interactions and Cooperation with SOX6," Genes Dev. 24(8):783-798 (2010).
Yamano, T., et al., "Crystal Structure of Cpf1 in Complex with Guide RNA and Target DNA," Cell 165(4):949-962 (2016).
Yan, W. X., et al., "Functionally Diverssse Type V CRISPR-Cas Systems," Science 363:88-91 (2019).
Yang, H., et al., "One-Step Generation of Mice Carrying Reporter and Conditional Alleles by CRISPR/Cas-Mediated Genome Engineering," Cell 154(6):1370-1390 (2013).
Zetsche, B., et al., "A Split-Cas9 Architecture for Inducible Genome Editing and Transcription Modulation," Nat. Biotechnol. 33(2):139-142 (2015).
Zetsche, B., et al., "Cpf1 Is a Single RNA-Guided Endonuclease of a Class 2 CRISPR-Cas System," Cell 163(3):759-771 (2015).
Zetsche, B., et al., "Multiplex Gene Editing by CRISPR-Cpf1 Through Autonomous Processing of a Single crRNA Array," Nat. Biotechnol. 35(1):31-34 (2017).
Zou, J., et al., "Gene Targeting of a Disease-Related Gene in Human Induced Pluripotent Stem and Embryonic Stem Cells," Cell Stem Cell 5(1):97-110 (2009).
Zou, J., et al., "Site-Specific Gene Correction of a Point Mutation in Human iPS Cells Derived from an Adult Patient with Sickle Cell Disease," Blood 118(17):4599-4608 (2011).
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jun. 12, 2017 for PCT/US2017/024163.
European Patent Office, International Search Report and Written Opinion dated Jul. 28, 2016 for PCT/US2016/029252.
European Patent Office, International Search Report and Written Opinion dated May 29, 2017 for PCT/US2017/022377.
European Patent Office, International Search Report and Written Opinion dated Aug. 20, 2018 for PCT/US2018/022516.
European Patent Office, International Search Report and Written Opinion dated Dec. 3, 2018 for PCT/US2018/032172.
European Patent Office, International Search Report and Written Opinion dated Mar. 13, 2019 for PCT/US2018/059700.
European Patent Office, International Search Report and Written Opinion dated Jul. 1, 2019 for PCT/US2019/022360.
European Patent Office, International Search Report and Written Opinion dated Mar. 6, 2020 for PCT/US2019/063766, 12 pages.
United States Patent and Trademark Office, International Search Report and Written Opinion for PCT/US2013/075317, dated Apr. 15, 2014, 12 pages.
United States Patent and Trademark Office, International Search Report and Written Opinion for PCT/US2013/075326, dated Aug. 22, 2014, 13 pages.
United States Patent and Trademark Office, International Search Report and Written Opinion for PCT/US2014/027335, dated Jul. 16, 2014, 13 pages.
United States Patent and Trademark Office, International Search Report and Written Opinion for PCT/US2014/028630, dated Jul. 24, 2014, 9 pages.
De Dreuzy, E., et al., "EDIT-301: An Experimental Autologous Cell Therapy Comprising Cas12a-RNP Modified mPB-CD34+ Cells for the Potential Treatment of SCD," Blood 134(Suppl. 1):4636 (2019).
De Dreuzy, E., et al., "Robust Pre-Clinical Results and Large-Scale Manufacturing Process for Edit-301: An Autologous Cell Therapy for the Potential Treatment of SCD," Blood 136(Suppl. 1):45-46 (2020).
Heath, J., et al., "EDIT-301: An Autologous Cell Therapy to Promote Fetal Hemoglobin Expression for the Potential Treatment of Sickle Cell Disease," Hemasphere 4(S1):S292 (2020).
European Patent Office, International Search Report and Written Opinion dated Apr. 13, 2021 for PCT/US2020/063854, 18 pages.
Bernaudin, F., et al., "Long-Term Results of Related Myeloablative Stem-Cell Transplantation to Cure Sickle Cell Disease," Blood 110(7):2749-2756 (2007).
Steinberg, M. H., et al., "Fetal Hemoglobin in Sickle Cell Anemia: A Glass Half Full?" Blood 123(4):481-485 (2014).
Van Diemen, F. R., et al., "CRISPR/Cas9, A Powerful Tool to Target Human Herpesviruses," Cell. Microbiol. 19:e12694 (2017).
Walters, M. C., et al., "Bone Marrow Transplantation for Sickle Cell Disease," New Engl. J. Med. 335(6):369-376 (1996).
European Patent Office, International Search Report and Written Opinion dated Nov. 22, 2022 for PCT/US2022/039192, 13 pages.

\* cited by examiner

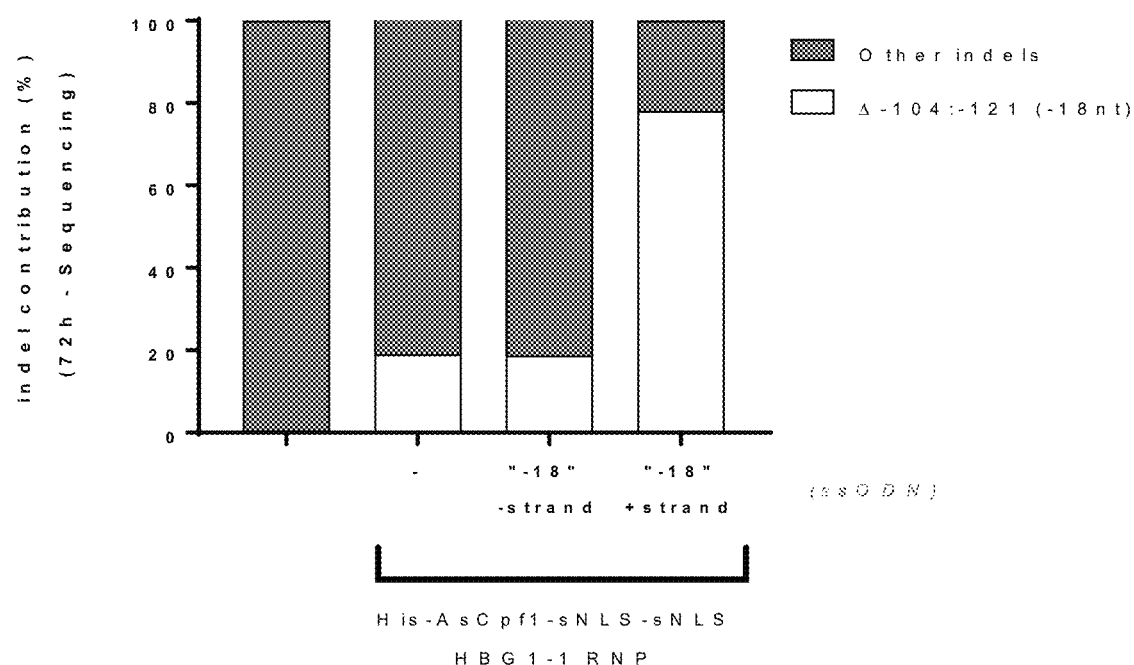

A

SEQ ID NO: 1269

SEQ ID NO: 1270

B

SEQ ID NO: 1269

SEQ ID NO: 1270

C

SEQ ID NO: 1269

SEQ ID NO: 1270

D

SEQ ID NO: 1269

SEQ ID NO: 1270

E

SEQ ID NO: 1269

SEQ ID NO: 1270

F

SEQ ID NO: 1269

SEQ ID NO: 1270

▶ D10A nick sites
▷ Cpf1 nick sites

SEQ ID NO: 1267

SEQ ID NO: 1268

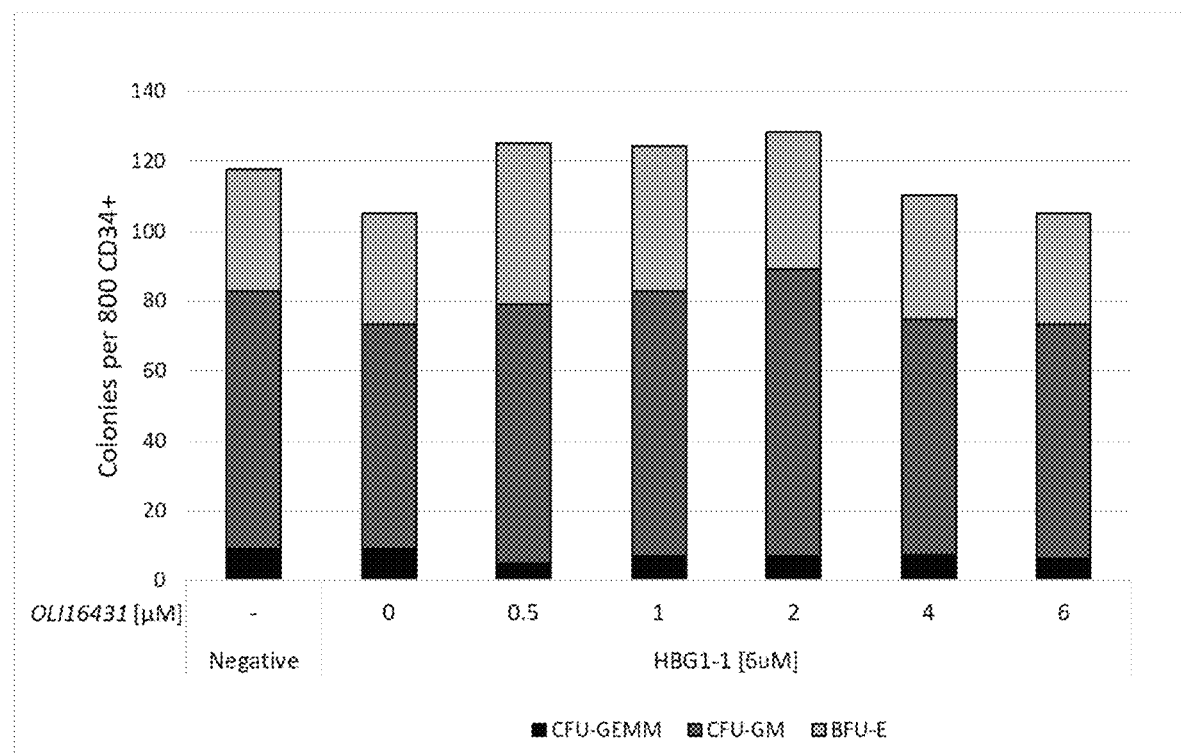

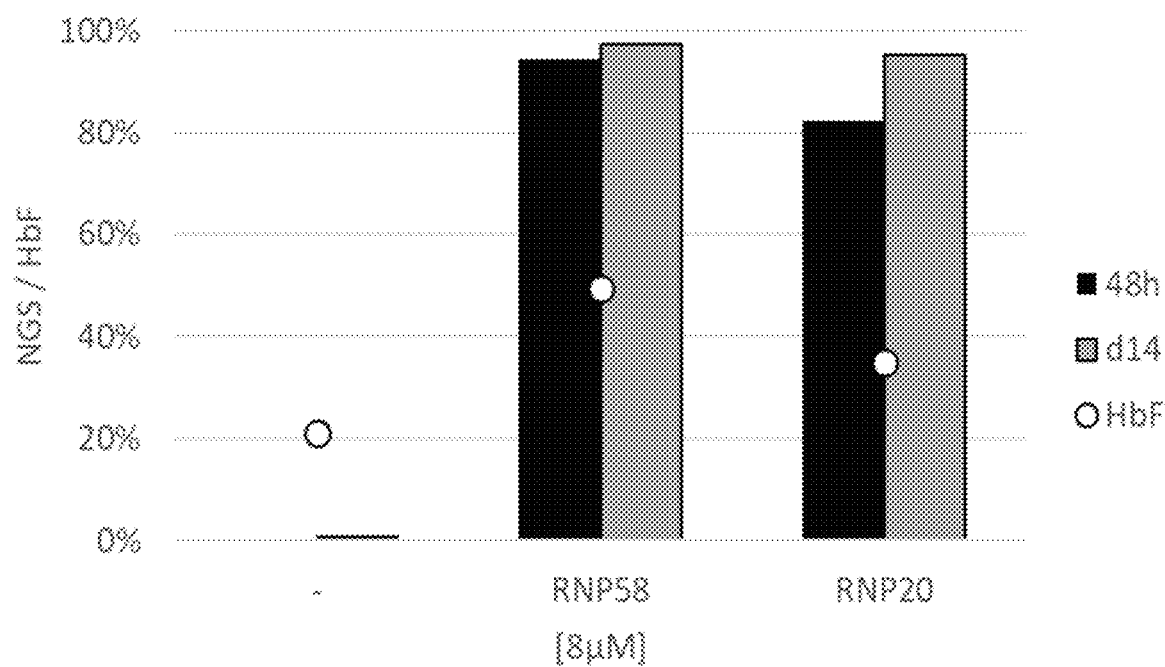

FIG 62

His-AsCpf1-sNLS-sNLS H800A amino acid sequence (SEQ ID NO:1032)

MGHHHHHHGSTQFEGFTNLYQVSKTLRFELIPQGKTLKHIQEQGFIEEDKARNDHYKELKPIIDRIYKTYAD
QCLQLVQLDWENLSAAIDSYRKEKTEETRNALIEEQATYRNAIHDYFIGRTDNLTDAINKRHAEIYKGLFKA
ELFNGKVLKQLGTVTTTEHENALLRSFDKFTTYFSGFYENRKNVFSAEDISTAIPHRIVQDNFPKFKENCHIF
TRLITAVPSLREHFENVKKAIGIFVSTSIEEVFSFPFYNQLLTQTQIDLYNQLLGGISREAGTEKIKGLNEVLNL
AIQKNDETAHIIASLPHRFIPLFKQILSDRNTLSFILEEFKSDEEVIQSFCKYKTLLRNENVLETAEALFNELNSI
DLTHIFISHKKLETISSALCDHWDTLRNALYERRISELTGKITKSAKEKVQRSLKHEDINLQEIISAAGKELSE
AFKQKTSEILSHAHAALDQPLPTTLKKQEEKEILKSQLDSLLGLYHLLDWFAVDESNEVDPEFSARLTGIKL
EMEPSLSFYNKARNYATKKPYSVEKFKLNFQMPTLASGWDVNKEKNNGAILFVKNGLYYLGIMPKQKGR
YKALSFEPTEKTSEGFDKMYYDYFPDAAKMIPKCSTQLKAVTAHFQTHTTPILLSNNFIEPLEITKEIYDLNN
PEKEPKKFQTAYAKKTGDQKGYREALCKWIDFTRDFLSKYTKTTSIDLSSLRPSSQYKDLGEYYAELNPLL
YHISFQRIAEKEIMDAVETGKLYLFQIYNKDFAKGHHGKPNLHTLYWTGLFSPENLAKTSIKLNGQAELFYR
PKSRMKRMAARLGEKMLNKKLKDQKTPIPDTLYQELYDYVNHRLSHDLSDEARALLPNVITKEVSHEIIKD
RRFTSDKFFFHVPITLNYQAANSPSKFNQRVNAYLKEHPETPIIGIDRGERNLIYITVIDSTGKILEQRSLNTIQ
QFDYQKKLDNREKERVAARQAWSVVGTIKDLKQGYLSQVIHEIVDLMIHYQAVVVLENLNFGFKSKRTGI
AEKAVYQQFEKMLIDKLNCLVLKDYPAEKVGGVLNPYQLTDQFTSFAKMGTQSGFLFYVPAPYTSKIDPL
TGFVDPFVWKTIKNHESRKHFLEGFDFLHYDVKTGDFILHFKMNRNLSFQRGLPGFMPAWDIVFEKNETQF
DAKGTPFIAGKRIVPVIENHRFTGRYRDLYPANELIALLEEKGIVFRDGSNILPKLLENDDSHAIDTMVALIRS
VLQMRNSNAATGEDYINSPVRDLNGVCFDSRFQNPEWPMDADANGAYHIALKGQLLLNHLKESKDLKLQ
NGISNQDWLAYIQELRNGSPKKKRKVGSPKKKRKV

His-AsCpf1-sNLS-sNLS H800A nucleotide sequence (SEQ ID NO:1110)

ATGGGC<u>CATCATCATCACCATCAC</u>GGTAGCACCCAGTTTGAAGGCTTTACCAATCTGTATCAGGTTAGC
AAAACCCTGCGTTTTGAACTGATTCCGCAGGGTAAAACCCTGAAACATATTCAAGAACAGGGCTTCAT
CGAAGAGGATAAAGCACGTAACGATCACTACAAAGAACTGAAACCGATTATCGACCGCATCTATAAA
ACGTACGCAGATCAGTGTCTGCAGCTGGTTCAGCTGGATTGGGAAAATCTGAGCGCAGCAATTGATAG
TTATCGCAAAGAGAAAACCGAAGAAACCCGTAATGCACTGATTGAAGAACAGGCAACCTATCGTAAT
GCCATCCATGATTATTTCATTGGTCGTACCGATAATCTGACCGATGCAATTAACAAACGTCACGCCGA
AATCTATAAAGGCCTGTTTAAAGCCGAACTGTTTAATGGCAAAGTTCTGAAACAGCTGGGCACCGTTA
CCACCACCGAACATGAAAATGCACTGCTGCGTAGCTTTGATAAATTCACCACCTATTTCAGCGGCTTTT
ATGAGAATCGCAAAAACGTGTTTAGCGCAGAAGATATTAGCACCGCAATTCCGCATCGTATTGTGCAG
GATAATTTCCCGAAATTCAAAGAGAACTGCCACATTTTTACCCGTCTGATTACCGCAGTTCCGAGCCTG
CGTGAACATTTTGAAAACGTTAAAAAAGCCATCGGCATCTTTGTTAGCACCAGCATTGAAGAAGTTTT
TAGCTTCCCGTTTTACAATCAGCTGCTGACCCAGACACAGATTGATCTGTATAACCAGCTGTTAGGTGG
TATTAGCCGTGAAGCAGGCACCGAAAAAATCAAAGGTCTGAATGAAGTGCTGAATCTGGCCATTCAG
AAAAATGATGAAACCGCACATATTATTGCAAGCCTGCCGCATCGTTTTATTCCGCTGTTTAAGCAGATT
CTGAGCGATCGTAATACCCTGAGCTTTATTCTGGAAGAATTCAAATCCGATGAAGAGGTGATTCAGAG
CTTCTGCAAATACAAAACGCTGCTGCGCAATGAAAATGTTCTGGAAACTGCCGAAGCACTGTTTAACG
AACTGAATAGCATTGATCTGACCCACATCTTTATCAGCCACAAAAAACTGGAAACCATTTCAAGCGCA
CTGTGTGATCATTGGGATACCCTGCGTAATGCCCTGTATGAACGTCGTATTAGCGAACTGACCGGTAA
AATTACCAAAAGCGCGAAAGAAAAAGTTCAGCGCAGTCTGAAACATGAGGATATTAATCTGCAAGAG
ATTATTAGCGCAGCCGGTAAAGAACTGTCAGAAGCATTTAAACAGAAACCAGCGAAATTCTGAGCC
ATGCACATGCAGCACTGGATCAGCCGCTGCCGACCACACTGAAAAAACAAGAAGAAAAAGAGATCCT
GAAAAGCCAGCTGGATAGCCTGCTGGGTCTGTATCATCTGCTGGACTGGTTTGCAGTTGATGAAAGCA
ATGAAGTTGATCCGGAATTTAGCGCACGTCTGACCGGCATTAAGCTGGAAATGGAACCGAGCCTGAGT
TTTTACAATAAAGCCCGTAATTATGCCACCAAAAAACCGTATAGCGTGGAAAAATTCAAGCTGAACTT
CCAGATGCCGACACTGGCAAGCGGTTGGGATGTTAATAAAGAAAAGAACAATGGTGCCATCCTGTTCG
TGAAAAATGGCCTGTATTATCTGGGTATCATGCCGAAACAGAAAGGTCGTTATAAAGCACTGAGCTTT
GAACCGACAGAAAAAACCAGTGAAGGCTTCGATAAATGTACTATGATTACTTTCCGGACGCAGCCA
AAATGATTCCGAAATGCAGCACCCAGCTGAAAGCAGTTACCGCACATTTTCAGACCCATACCACACCG
ATTCTGCTGAGCAATAACTTTATTGAACCGCTGGAAATCACCAAAGAGATCTACGATCTGAATAACCC

FIG 62 (cont'd)

GGAAAAAGAGCCGAAAAAGTTTCAGACCGCCTATGCAAAAAAAACCGGTGATCAGAAAGGTTATCGT
GAAGCGCTGTGTAAATGGATTGATTTCACCCGTGATTTTCTGAGCAAATACACCAAAACCACCAGTAT
CGATCTGAGCAGCCTGCGTCCGAGCAGCCAGTATAAAGATCTGGGCGAATATTATGCAGAACTGAATC
CGCTGCTGTATCATATTAGCTTTCAGCGTATTGCCGAGAAAGAAATAATGGATGCAGTTGAAACCGGT
AAGCTGTACCTGTTCCAGATTTATAACAAAGACTTTGCCAAAGGCCATCATGGTAAACCGAATCTGCA
TACCCTGTATTGGACCGGTCTGTTTAGCCCTGAAAATCTGGCAAAAACCAGCATTAAACTGAATGGTC
AGGCGGAACTGTTTTATCGTCCGAAAAGCCGTATGAAACGTATGGCAGCACGTCTGGGTGAAAAAATG
CTGAATAAAAAGCTGAAGGATCAGAAAACCCCGATTCCGGATACACTGTATCAAGAGCTGTATGATTA
TGTGAATCATCGTCTGAGTCATGATCTGAGTGATGAAGCACGTGCCCTGCTGCCGAATGTTATTACCAA
AGAAGTTAGCCACGAGATCATTAAAGATCGTCGTTTTACCAGCGACAAGTTTTTTTTCCATGTTCCGAT
TACGCTGAATTATCAGGCAGCAAATAGCCCGAGCAAATTTAACCAGCGTGTGAATGCATATCTGAAAG
AACATCCGGAAACACCGATTATTGGTATTGATCGTGGTGAACGCAACCTGATTTATATCACCGTTATTG
ATAGCACCGGCAAGATCCTGGAACAGCGTAGCCTGAATACCATTCAGCAGTTTGATTATCAGAAAAAG
CTGGACAACCGTGAAAAGAACGTGTTGCAGCCCGTCAGGCATGGTCAGTTGTTGGTACAATTAAAGA
CCTGAAACAGGGTTATCTGAGCCAGGTTATTCATGAAATTGTGGATCTGATGATTCATTACCAGGCAG
TTGTTGTGCTGGAAAACCTGAATTTTGGCTTTAAAAGCAAACGTACCGGCATTGCGGAAAAAGCAGTT
TATCAGCAGTTCGAAAAGATGCTGATCGATAAACTGAACTGTCTGGTGCTGAAAGATTATCCGGCTGA
AAAAGTTGGCGGTGTTCTGAATCCGTATCAGCTGACCGATCAGTTTACCAGCTTTGCAAAAATGGGCA
CCCAGAGCGGATTTCTGTTTTATGTTCCGGCACCGTATACGAGCAAAATTGATCCGCTGACCGGTTTTG
TTGATCCGTTTGTTTGGAAAACCATCAAAAACCATGAAAGCCGCAAACATTTTCTGGAAGGTTTTGATT
TCCTGCATTACGACGTTAAGACCGGTGATTTTATTCTGCACTTTAAGATGAATCGGAACCTGTCATTTC
AGCGTGGTCTGCCTGGTTTTATGCCTGCATGGGATATTGTGTTTGAGAAAAACGAAACACAGTTCGAT
GCAAAAGGCACCCCGTTTATTGCAGGTAAACGTATTGTTCCGGTGATTGAAAATCATCGTTTCACCGGT
CGTTATCGCGATCTGTATCCGGCAAATGAACTGATCGCACTGCTGGAAGAGAAAGGTATTGTTTTTCGT
GATGGCTCAAACATTCTGCCGAAACTGTTAGAGAATGATGATAGCCATGCCATTGATACCATGGTTGC
CCTGATTCGTAGCGTTCTGCAGATGCGTAATAGCAATGCAGCAACCGGTGAAGATTACATTAATAGTC
CGGTTCGTGATCTGAATGGTGTTTGTTTTGATAGCCGTTTTCAGAATCCGGAATGGCCGATGGATGCGG
ATGCAAATGGTGCATATCATATTGCACTGAAAGGACAGCTGCTGCTGAACCACCTGAAAGAAAGTAA
AGATTTGAAGCTGCAGAATGGCATTAGCAATCAGGATTGGCTGGCATATATCCAAGAACTGCGTAACG
GTTCTCCTAAGAAAAAGCGCAAAGTTGGCAGTCCGAAGAAGAAACGTAAGGTT

Cpf1-1 amino acid sequence (SEQ ID NO:1094)

MTQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL
REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN
KARNYATKKPYSVEKFKLNFQRPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEPLEITKEIYDLNNPEKEPKKFQTA
YAKKTGDQKGYREALCKWIDFTRDFLSKYTKTTSIDLSSLRPSSQYKDLGEYYAELNPLLYHISFQRIAEKEI
MDAVETGKLYLFQIYNKDFAKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVITKEVSHEIIKDRRFTSDKFLFH
VPITLNYQAANSPSKFNQRVNAYLKEHPETPIIGIDRGERNLIYITVIDSTGKILEQRSLNTIQQFDYQKKLDN
REKERVAARQAWSVVGTIKDLKQGYLSQVIHEIVDLMIHYQAVVVLENLNFGFKSKRTGIAEKAVYQQFE
KMLIDKLNCLVLKDYPAEKVGGVLNPYQLTDQFTSFAKMGTQSGFLFYVPAPYTSKIDPLTGFVDPFVWK
TIKNHESRKHFLEGFDFLHYDVKTGDFILHFKMNRNLSFQRGLPGFMPAWDIVFEKNETQFDAKGTPFIAG
KRIVPVIENHRFTGRYDLYPANELIALLEEKGIVFRDGSNILPKLLENDDSHAIDTMVALIRSVLQMRNSNA
ATGEDYINSPVRDLNGVCFDSRFQNPEWPMDADANGAYHIALKGQLLLNHLKESKDLKLQNGISNQDWL
AYIQELRNGRSSDDEATADSQHAAPPKKKRKVGGSGGSGGSGGSGGSGGSGGSGGSLEHHHHHH

FIG 62 (cont'd)

Cpf1-1 nucleotide sequence (SEQ ID NO:1111)

ATGACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC
AGAAGATATTAGCACCGCAATTCCGCATCGTATTGTGCAGGATAATTTCCCGAATTCAAAGAGAACT
GCCACATTTTTACCCGTCTGATTACCGCAGTTCCGAGCCTGCGTGAACATTTTGAAAACGTTAAAAAG
CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAAATGTTCTGGAAACTGCCGAAGCACTGTTTAACAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC
AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGCGTCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCACATCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCCTGTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT
CGTGGTGAACGTAACCTGATTTATATCACCGTTATTGATAGCACCGGCAAAATCCTGGAACAGCGTAG
CCTGAATACCATTCAGCAGTTTGATTACCAGAAAAAACTGGATAATCGCGAGAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCCGTTTATTGCAGGTAAACG

FIG 62 (cont'd)

TATTGTTCCGGTGATTGAAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGT**AGCAGTGATGATGAAGCAACCGCA
GATAGCCAGCATGCAGCACCGCCTAAAAAGAAACGTAAAGTTGGTGGTAGCGGTGGTTCAGGTGG
TAGTGGCGGTAGTGGTGGCTCAGGGGGTTCTGGTGGCTCTGGTGGTAGCCTCGAG**<u>CACCACCACCACC
ACCAC</u>

Cpf1-2 amino acid sequence (SEQ ID NO:1095)

MTQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL
REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN
KARNYATKKPYSVEKFKLNFQMPTLASGWDVNKEKNNGAILFVKNGLYYLGIMPKQKGRYKALSFEPTE
KTSEGFDKMYYDYFPDAAKMIPKCSTQLKAVTAHFQTHTTPILLSNNFIEPLEITKEIYDLNNPEKEPKKFQT
AYAKKTGDQKGYREALCKWIDFTRDFLSKYTKTTSIDLSSLRPSSQYKDLGEYYAELNPLLYHISFQRIAEK
EIMDAVETGKLYLFQIYNKDFAKGHHGKPNLHTLYWTGLFSPENLAKTSIKLNGQAELFYRPKSRMKRMA
HRLGEKMLNKKLKDQKTPIPDTLYQELYDYVNHRLSHDLSDEARALLPNVITKEVSHEIIKDRRFTSDKFFF
HVPITLNYQAANSPSKFNQRVNAYLKEHPETPIIGIDRGERNLIYITVIDSTGKILEQRSLNTIQQFDYQKKLD
NREKERVAARQAWSVVGTIKDLKQGYLSQVIHEIVDLMIHYQAVVVLENLNFGFKSKRTGIAEKAVYQQF
EKMLIDKLNCLVLKDYPAEKVGGVLNPYQLTDQFTSFAKMGTQSGFLFYVPAPYTSKIDPLTGFVDPFVW
KTIKNHESRKHFLEGFDFLHYDVKTGDFILHFKMNRNLSFQRGLPGFMPAWDIVFEKNETQFDAKGTPFIA
GKRIVPVIENHRFTGRYRDLYPANELIALLEEKGIVFRDGSNILPKLLENDDSHAIDTMVALIRSVLQMRNSN
AATGEDYINSPVRDLNGVCFDSRFQNPEWPMDADANGAYHIALKGQLLLNHLKESKDLKLQNGISNQDW
LAYIQELRNGRSSDDEATADSQHAAPPKKKRKVGGSGGSGGSGGSGGSGGSGGSGGSLE<u>HHHHHH</u>

Cpf1-2 nucleotide sequence (SEQ ID NO:1112)

ATGACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAGAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC
AGAAGATATTAGCACCGCAATTCCGCATCGTATTGTGCAGGATAATTTCCCGAAATTCAAAGAGAACT
GCCACATTTTTACCCGTCTGATTACCGCAGTTCCGAGCCTGCGTGAACATTTTGAAAACGTTAAAAAAG
CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAAATGTTCTGGAAACTGCCGAAGCACTGTTTAACGAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC

FIG 62 (cont'd)

AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGATGCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCACATCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCTTTTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT
CGTGGTGAACGTAACCTGATTTATATCACCGTTATTGATAGCACCGGCAAAATCCTGGAACAGCGTAG
CCTGAATACCATTCAGCAGTTTGATTACCAGAAAAACTGGATAATCGCGAGAAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCGTTTATTGCAGGTAAACG
TATTGTTCCGGTGATTGAAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGT<u>AGCAGTGATGATGAAGCAACCGCA
GATAGCCAGCATGCAGCACCGCCTAAAAAGAAACGTAAAGTTGGTGGTAGCGGTGGTTCAGGTGG
TAGTGGCGGTAGTGGTGGCTCAGGGGGTTCTGGTGGCTCTGGTGGTAGCCTCGAGCACCACCACCACC
ACCAC</u>

Cpf1-3 amino acid sequence (SEQ ID NO:1096)

MTQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL
REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN

FIG 62 (cont'd)

KARNYATKKPYSVEKFKLNFQRPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEPLEITKEIYDLNNPEKEPKKFQTA
YAKKTGDQKGYREALCKWIDFTRDFLSKYTKTTSIDLSSLRPSSQYKDLGEYYAELNPLLYHISFQRIAEKEI
MDAVETGKLYLFQIYNKDFAKGHHGKPNLHTLYWTGLFSPENLAKTSIKLNGQAELFYRPKSRMKRMAA
RLGEKMLNKKLKDQKTPIPDTLYQELYDYVNHRLSHDLSDEARALLPNVITKEVSHEIIKDRRFTSDKFLFH
VPITLNYQAANSPSKFNQRVNAYLKEHPETPIIGIDRGERNLIYITVIDSTGKILEQRSLNTIQQFDYQKKLDN
REKERVAARQAWSVVGTIKDLKQGYLSQVIHEIVDLMIHYQAVVVLENLNFGFKSKRTGIAEKAVYQQFE
KMLIDKLNCLVLKDYPAEKVGGVLNPYQLTDQFTSFAKMGTQSGFLFYVPAPYTSKIDPLTGFVDPFVWK
TIKNHESRKHFLEGFDFLHYDVKTGDFILHFKMNRNLSFQRGLPGFMPAWDIVFEKNETQFDAKGTPFIAG
KRIVPVIENHRFTGRYRDLYPANELIALLEEKGIVFRDGSNILPKLLENDDSHAIDTMVALIRSVLQMRNSNA
ATGEDYINSPVRDLNGVCFDSRFQNPEWPMDADANGAYHIALKGQLLLNHLKESKDLKLQNGISNQDWL
AYIQELRNGRSSDDEATADSQHAAPPKKKRKVGGSGGSGGSGGSGGSGGSGGSGGSLEHHHHHH

Cpf1-3 nucleotide sequence (SEQ ID NO:1113)

ATGACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAGAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC
AGAAGATATTAGCACCGCAATTCCGCATCGTATTGTGCAGGATAATTTCCCGAAATTCAAAGAGAACT
GCCACATTTTTACCCGTCTGATTACCGCAGTTCCGAGCCTGCGTGAACATTTTGAAAACGTTAAAAAAG
CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAAATGTTCTGGAAACTGCCGAAGCACTGTTTAACGAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC
AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGCGTCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCAGCTCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCCTGTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT

FIG 62 (cont'd)

CGTGGTGAACGTAACCTGATTTATATCACCGTTATTGATAGCACCGGCAAAATCCTGGAACAGCGTAG
CCTGAATACCATTCAGCAGTTTGATTACCAGAAAAAACTGGATAATCGCGAGAAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCCGTTTATTGCAGGTAAACG
TATTGTTCCGGTGATTGAAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGT**AGCAGTGATGATGAAGCAACCGCA
GATAGCCAGCATGCAGCACCGCCTAAAAAGAAACGTAAAGTT**GGTGGTAGCGGTGGTTCAGGTGG
TAGTGGCGGTAGTGGTGGCTCAGGGGGTTCTGGTGGCTCTGGTGGTAGCCTCGAG<ins>CACCACCACCACC
ACCAC</ins>

Cpf1-4 amino acid sequence (SEQ ID NO:1097)

MTQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL
REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN
KARNYATKKPYSVEKFKLNFQRPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEPLEITKEIYDLNNPEKEPKKFQTA
YAKKTGDQKGYREALCKWIDFTRDFLSKYTKTTSIDLSSLRPSSQYKDLGEYYAELNPLLYHISFQRIAEKEI
MDAVETGKLYLFQIYNKDFAKGHHGKPNLHTLYWTGLFSPENLAKTSIKLNGQAELFYRPKSRMKRMAA
RLGEKMLNKKLKDQKTPIPDTLYQELYDYVNHRLSHDLSDEARALLPNVITKEVSHEIIKDRRFTSDKFLFH
VPITLNYQAANSPSKFNQRVNAYLKEHPETPIIGIDRGERNLIYITVIDSTGKILEQRSLNTIQQFDYQKKLDN
REKERVAARQAWSVVGTIKDLKQGYLSQVIHEIVDLMIHYQAVVVLENLNFGFKSKRTGIAEKAVYQQFE
KMLIDKLNCLVLKDYPAEKVGGVLNPYQLTDQFTSFAKMGTQSGFLFYVPAPYTSKIDPLTGFVDPFVWK
TIKNHESRKHFLEGFDFLHYDVKTGDFILHFKMNRNLSFQRGLPGFMPAWDIVFEKNETQFDAKGTPFIAG
KRIVPVIENHRFTGRYRDLYPANELIALLEEKGIVFRDGSNILPKLLENDDSHAIDTMVALIRSVLQMRNSNA
ATGEDYINSPVRDLNGVCFDSRFQNPEWPMDADANGAYHIALKGQLLLNHLKESKDLKLQNGISNQDWL
AYIQELRNGRSSDDEATADSQHAAPPKKKRKV

Cpf1-4 nucleotide sequence (SEQ ID NO:1114)

ATGACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAGAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC
AGAAGATATTAGCACCGCAATTCCGCATCGTATTGTGCAGGATAATTTCCCGAAATTCAAAGAGAACT
GCCACATTTTTACCCGTCTGATTACCGCAGTTCCGAGCCTGCGTGAACATTTTGAAAACGTTAAAAAAG

FIG 62 (cont'd)

CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAATGTTCTGGAAACTGCCGAAGCACTGTTTAACGAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC
AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGCGTCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCAGCTCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCCTGTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT
CGTGGTGAACGTAACCTGATTTATATCACCGTTATTGATAGCACCGGCAAAATCCTGGAACAGCGTAG
CCTGAATACCATTCAGCAGTTTGATTACCAGAAAAAACTGGATAATCGCGAGAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCCGTTTATTGCAGGTAAACG
TATTGTTCCGGTGATTGAAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGTAGCAGTGATGATGAAGCAACCGCA
GATAGCCAGCATGCAGCACCGCCTAAAAAGAAACGTAAAGTT

Cpf1-5 amino acid sequence (SEQ ID NO:1107)

STQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL

FIG 62 (cont'd)

REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN
KARNYATKKPYSVEKFKLNFQRPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEPLEITKEIYDLNNPEKEPKKFQTA
YAKKTGDQKGYREALCKWIDFTRDFLSKYTKTTSIDLSSLRPSSQYKDLGEYYAELNPLLYHISFQRIAEKEI
MDAVETGKLYLFQIYNKDFAKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVITKEVSHEIIKDRRFTSDKFLFH
VPITLNYQAANSPSKFNQRVNAYLKEHPETPIIGIDRGERNLIYITVIDSTGKILEQRSLNTIQQFDYQKKLDN
REKERVAARQAWSVVGTIKDLKQGYLSQVIHEIVDLMIHYQAVVVLENLNFGFKSKRTGIAEKAVYQQFE
KMLIDKLNCLVLKDYPAEKVGGVLNPYQLTDQFTSFAKMGTQSGFLFYVPAPYTSKIDPLTGFVDPFVWK
TIKNHESRKHFLEGFDFLHYDVKTGDFILHFKMNRNLSFQRGLPGFMPAWDIVFEKNETQFDAKGTPFIAG
KRIVPVIENHRFTGRYRDLYPANELIALLEEKGIVFRDGSNILPKLLENDDSHAIDTMVALIRSVLQMRNSNA
ATGEDYINSPVRDLNGVCFDSRFQNPEWPMDADANGAYHIALKGQLLLNHLKESKDLKLQNGISNQDWL
AYIQELRNGRSSDDEATADSQHAAPPKKKRKV

Cpf1-5 nucleotide sequence (SEQ ID NO:1115)

AGCACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAGAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC
AGAAGATATTAGCACCGCAATTCCGCATCGTATTGTGCAGGATAATTTCCCGAAATTCAAAGAGAACT
GCCACATTTTTACCCGTCTGATTACCGCAGTTCCGAGCCTGCGTGAACATTTTGAAAACGTTAAAAAAG
CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAAATGTTCTGGAAACTGCCGAAGCACTGTTTAACGAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC
AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGCGTCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCACATCGTCTGGGTGAAAAAATGCTGAACAAAAAACTGAAAGACCAGAAAACCCCG

FIG 62 (cont'd)

ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCCTGTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT
CGTGGTGAACGTAACCTGATTTATATCACCGTTATTGATAGCACCGGCAAAATCCTGGAACAGCGTAG
CCTGAATACCATTCAGCAGTTTGATTACCAGAAAAAACTGGATAATCGCGAGAAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCCGTTTATTGCAGGTAAACG
TATTGTTCCGGTGATTGAAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGT**AGCAGTGATGATGAAGCAACCGCA
GATAGCCAGCATGCAGCACCGCCTAAAAAGAAACGTAAAGTT**

Cpf1-6 amino acid sequence (SEQ ID NO:1108)

STQFEGFTNLYQVSKTLRFELIPQGKTLKHIQEQGFIEEDKARNDHYKELKPIIDRIYKTYADQCLQLVQLD
WENLSAAIDSYRKEKTEETRNALIEEQATYRNAIHDYFIGRTDNLTDAINKRHAEIYKGLFKAELFNGKVLK
QLGTVTTTEHENALLRSFDKFTTYFSGFYENRKNVFSAEDISTAIPHRIVQDNFPKFKENCHIFTRLITAVPSL
REHFENVKKAIGIFVSTSIEEVFSFPFYNQLLTQTQIDLYNQLLGGISREAGTEKIKGLNEVLNLAIQKNDETA
HIIASLPHRFIPLFKQILSDRNTLSFILEEFKSDEEVIQSFCKYKTLLRNENVLETAEALFNELNSIDLTHIFISHK
KLETISSALCDHWDTLRNALYERRISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVDPEFSARLTGIKLEMEPSLSFYN
KARNYATKKPYSVEKFKLNFQRPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEPLEITKEIYDLNNPEKEPKKFQTA
YAKKTGDQKGYREALCKWIDFTRDFLSKYTKTTSIDLSSLRPSSQYKDLGEYYAELNPLLYHISFQRIAEKEI
MDAVETGKLYLFQIYNKDFAKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVITKEVSHEIIKDRRFTSDKFLFH
VPITLNYQAANSPSKFNQRVNAYLKEHPETPIIGIDRGERNLIYITVIDSTGKILEQRSLNTIQQFDYQKKLDN
REKERVAARQAWSVVGTIKDLKQGYLSQVIHEIVDLMIHYQAVVVLENLNFGFKSKRTGIAEKAVYQQFE
KMLIDKLNCLVLKDYPAEKVGGVLNPYQLTDQFTSFAKMGTQSGFLFYVPAPYTSKIDPLTGFVDPFVWK
TIKNHESRKHFLEGFDFLHYDVKTGDFILHFKMNRNLSFQRGLPGFMPAWDIVFEKNETQFDAKGTPFIAG
KRIVPVIENHRFTGRYRDLYPANELIALLEEKGIVFRDGSNILPKLLENDDSHAIDTMVALIRSVLQMRNSNA
ATGEDYINSPVRDLNGVCFDSRFQNPEWPMDADANGAYHIALKGQLLLNHLKESKDLKLQNGISNQDWL
AYIQELRNGRSSDDEATADSQHAAPPKKKRKVGGSGGSGGSGGSGGSGGSGGSLEHHHHHH

Cpf1-6 nucleotide sequence (SEQ ID NO:1116)

AGCACCCAGTTTGAAGGTTTCACCAATCTGTATCAGGTTAGCAAAACCCTGCGTTTTGAACTGATTCCG
CAGGGTAAAACCCTGAAACATATTCAAGAACAGGGCTTCATCGAAGAGGATAAAGCACGTAACGATC
ACTACAAAGAACTGAAACCGATTATCGACCGCATCTATAAAACCTATGCAGATCAGTGTCTGCAGCTG
GTTCAGCTGGATTGGGAAAATCTGAGCGCAGCAATTGATAGTTATCGCAAAGAAAAAACCGAAGAAA
CCCGTAATGCACTGATTGAAGAACAGGCAACCTATCGTAATGCCATCCATGATTATTTCATTGGTCGTA
CCGATAATCTGACCGATGCAATTAACAAACGTCACGCCGAAATCTATAAAGGCCTGTTTAAAGCCGAA
CTGTTTAATGGCAAAGTTCTGAAACAGCTGGGCACCGTTACCACCACCGAACATGAAAATGCACTGCT
GCGTAGCTTTGATAAATTCACCACCTATTTCAGCGGCTTTTATGAGAATCGCAAAAACGTGTTTAGCGC

FIG 62 (cont'd)

AGAAGATATTAGCACCGCAATTCCGCATCGTATTGTGCAGGATAATTTCCCGAAATTCAAAGAGAACT
GCCACATTTTTACCCGTCTGATTACCGCAGTTCCGAGCCTGCGTGAACATTTTGAAAACGTTAAAAAAG
CCATCGGCATCTTTGTTAGCACCAGCATTGAAGAAGTTTTTAGCTTCCCGTTTTACAATCAGCTGCTGA
CCCAGACCCAGATTGATCTGTATAACCAACTGCTGGGTGGTATTAGCCGTGAAGCAGGCACCGAAAAA
ATCAAAGGTCTGAATGAAGTGCTGAATCTGGCCATTCAGAAAAATGATGAAACCGCACATATTATTGC
AAGCCTGCCGCATCGTTTTATTCCGCTGTTCAAACAAATTCTGAGCGATCGTAATACCCTGAGCTTTAT
TCTGGAAGAATTCAAATCCGATGAAGAGGTGATTCAGAGCTTTTGCAAATACAAAACGCTGCTGCGCA
ATGAAAATGTTCTGGAAACTGCCGAAGCACTGTTTAACGAACTGAATAGCATTGATCTGACCCACATC
TTTATCAGCCACAAAAAACTGGAAACCATTTCAAGCGCACTGTGTGATCATTGGGATACCCTGCGTAA
TGCCCTGTATGAACGTCGTATTAGCGAACTGACCGGTAAAATTACCAAAAGCGCGAAAGAAAAAGTTC
AGCGCAGTCTGAAACATGAGGATATTAATCTGCAAGAGATTATTAGCGCAGCCGGTAAAGAACTGTCA
GAAGCATTTAAACAGAAAACCAGCGAAATTCTGTCACATGCACATGCAGCACTGGATCAGCCGCTGCC
GACCACCCTGAAAAAACAAGAAGAAAAAGAAATCCTGAAAAGCCAGCTGGATAGCCTGCTGGGTCTG
TATCATCTGCTGGACTGGTTTGCAGTTGATGAAAGCAATGAAGTTGATCCGGAATTTAGCGCACGTCT
GACCGGCATTAAACTGGAAATGGAACCGAGCCTGAGCTTTTATAACAAAGCCCGTAATTATGCCACCA
AAAAACCGTATAGCGTCGAAAAATTCAAACTGAACTTTCAGCGTCCGACCCTGGCAAGCGGTTGGGAT
GTTAATAAAGAAAAAAACAACGGTGCCATCCTGTTCGTGAAAAATGGCCTGTATTATCTGGGTATTAT
GCCGAAACAGAAAGGTCGTTATAAAGCGCTGAGCTTTGAACCGACGGAAAAAACCAGTGAAGGTTTT
GATAAAATGTACTACGACTATTTTCCGGATGCAGCCAAAATGATTCCGAAATGTAGCACCCAGCTGAA
AGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCA
TATGCAAAAAAAACCGGTGATCAGAAAGGTTATCGTGAAGCGCTGTGTAAATGGATTGATTTCACCCG
TGATTTTCTGAGCAAATACACCAAAACCACCAGTATCGATCTGAGCAGCCTGCGTCCGAGCAGCCAGT
ATAAAGATCTGGGCGAATATTATGCAGAACTGAATCCGCTGCTGTATCATATTAGCTTTCAGCGTATTG
CCGAGAAAGAAATCATGGACGCAGTTGAAACCGGTAAACTGTACCTGTTCCAGATCTACAATAAAGAT
TTTGCCAAAGGCCATCATGGCAAACCGAATCTGCATACCCTGTATTGGACCGGTCTGTTTAGCCCTGAA
AATCTGGCAAAAACCTCGATTAAACTGAATGGTCAGGCGGAACTGTTTTATCGTCCGAAAAGCCGTAT
GAAACGTATGGCACATCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGA
TGAAGCACGTGCCCTGCTGCCGAATGTTATTACCAAAGAAGTTAGCCACGAGATCATTAAAGATCGTC
GTTTTACCAGCGACAAATTCCTGTTTCATGTGCCGATTACCCTGAATTATCAGGCAGCAAATAGCCCGA
GCAAATTTAACCAGCGTGTTAATGCATATCTGAAAGAACATCCAGAAACGCCGATTATTGGTATTGAT
CGTGGTGAACGTAACCTGATTTATATCACCGTTATTGATAGCACCGGCAAAATCCTGGAACAGCGTAG
CCTGAATACCATTCAGCAGTTTGATTACCAGAAAAAACTGGATAATCGCGAGAAAGAACGTGTTGCAG
CACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTT
AAAAGCAAACGTACCGGCATTGCAGAAAAAGCAGTTTATCAGCAGTTCGAGAAAATGCTGATTGACA
AACTGAATTGCCTGGTGCTGAAAGATTATCCGGCTGAAAAAGTTGGTGGTGTTCTGAATCCGTATCAG
CTGACCGATCAGTTTACCAGCTTTGCAAAAATGGGCACCCAGAGCGGATTTCTGTTTTATGTTCCGGCA
CCGTATACGAGCAAAATTGATCCGCTGACCGGTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTC
ATCCTGCACTTTAAAATGAATCGCAATCTGAGTTTTCAGCGTGGCCTGCCTGGTTTTATGCCTGCATGG
GATATTGTGTTTGAGAAAAACGAAACACAGTTCGATGCAAAAGGCACCCCGTTTATTGCAGGTAAACG
TATTGTTCCGGTGATTGAAATCATCGTTTCACCGGTCGTTATCGCGATCTGTATCCGGCAAATGAACT
GATCGCACTGCTGGAAGAGAAAGGTATTGTTTTTCGTGATGGCTCAAACATTCTGCCGAAACTGCTGG
AAAATGATGATAGCCATGCAATTGATACCATGGTTGCACTGATTCGTAGCGTTCTGCAGATGCGTAAT
AGCAATGCAGCAACCGGTGAAGATTACATTAATAGTCCGGTTCGTGATCTGAATGGTGTTTGTTTTGAT
AGCCGTTTTCAGAATCCGGAATGGCCGATGGATGCAGATGCAAATGGTGCATATCATATTGCACTGAA
AGGACAGCTGCTGCTGAACCACCTGAAAGAAAGCAAAGATCTGAAACTGCAAAACGGCATTAGCAAT
CAGGATTGGCTGGCATATATCCAAGAACTGCGTAACGGTCGT**AGCAGTGATGATGAAGCAACCGCA
GATAGCCAGCATGCAGCACCGCCTAAAAAGAAACGTAAAGTTGGTGGTAGCGGTGGTTCAGGTGG
TAGTGGCGGTAGTGGTGGCTCAGGGGGTTCTGGTGGCTCTGGTGGTAGCCTCGAG**CACCACCACCACC
ACCAC

FIG 62 (cont'd)

Cpf1-7 amino acid sequence (SEQ ID NO:1109)

MGRDPGKPIPNPLLGLDSTAPKKKRKVGIHGVPAATQFEGFTNLYQVSKTLRFELIPQGKTLKHIQEQGFIEE
DKARNDHYKELKPIIDRIYKTYADQCLQLVQLDWENLSAAIDSYRKEKTEETRNALIEEQATYRNAIHDYFI
GRTDNLTDAINKRHAEIYKGLFKAELFNGKVLKQLGTVTTTEHENALLRSFDKFTTYFSGFYENRKNVFSA
EDISTAIPHRIVQDNFPKFKENCHIFTRLITAVPSLREHFENVKKAIGIFVSTSIEEVFSFPFYNQLLTQTQIDLY
NQLLGGISREAGTEKIKGLNEVLNLAIQKNDETAHIIASLPHRFIPLFKQILSDRNTLSFILEEFKSDEEVIQSFC
KYKTLLRNENVLETAEALFNELNSIDLTHIFISHKKLETISSALCDHWDTLRNALYERRISELTGKITKSAKE
KVQRSLKHEDINLQEIISAAGKELSEAFKQKTSEILSHAHAALDQPLPTTLKKQEEKEILKSQLDSLLGLYHL
LDWFAVDESNEVDPEFSARLTGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPDAAKMIPKCSTQLKAVTAHFQ
THTTPILLSNNFIEPLEITKEIYDLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLFQIYNKDFAKGHHGKPNLHTLY
WTGLFSPENLAKTSIKLNGQAELFYRPKSRMKRMAHRLGEKMLNKKLKDQKTPIPDTLYQELYDYVNHRL
SHDLSDEARALLPNVITKEVSHEIIKDRRFTSDKFFFHVPITLNYQAANSPSKFNQRVNAYLKEHPETPIIGID
RGERNLIYITVIDSTGKILEQRSLNTIQQFDYQKKLDNREKERVAARQAWSVVGTIKDLKQGYLSQVIHEIV
DLMIHYQAVVVLENLNFGFKSKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEGFDFLHYDVKTGDFILHFKMNR
NLSFQRGLPGFMPAWDIVFEKNETQFDAKGTPFIAGKRIVPVIENHRFTGRYRDLYPANELIALLEEKGIVFR
DGSNILPKLLENDDSHAIDTMVALIRSVLQMRNSNAATGEDYINSPVRDLNGVCFDSRFQNPEWPMDADA
NGAYHIALKGQLLLNHLKESKDLKLQNGISNQDWLAYIQELRNPKKKRKVKLAAALE<u>HHHHHH</u>

Cpf1-7 nucleotide sequence (SEQ ID NO:1117)

ATGGGTCGGGATCCAGGTAAACCGATTCCGAATCCGCTGCTGGGTCTGGATAGCACCGCACCGAAAAA
AAAACGTAAAGTTGGTATTCATGGTGTTCCGGCAGCAACCCAGTTTGAAGGTTTCACCAATCTGTATC
AGGTTAGCAAAACCCTGCGTTTTGAACTGATTCCGCAGGGTAAAACCCTGAAACATATTCAAGAACAG
GGCTTCATCGAAGAGGATAAAGCACGTAACGATCACTACAAGAACTGAAACCGATTATCGACCGCA
TCTATAAAACCTATGCAGATCAGTGTCTGCAGCTGGTTCAGCTGGATTGGGAAAATCTGAGCGCAGCA
ATTGATAGTTATCGCAAAGAAAAAACCGAAGAAACCCGTAATGCACTGATTGAAGAACAGGCAACCT
ATCGTAATGCCATCCATGATTATTTCATTGGTCGTACCGATAATCTGACCGATGCAATTAACAAACGTC
ACGCCGAAATCTATAAAGGCCTGTTTAAAGCCGAACTGTTTAATGGCAAAGTTCTGAAACAGCTGGGC
ACCGTTACCACCACCGAACATGAAAATGCACTGCTGCGTAGCTTTGATAAATTCACCACCTATTTCAGC
GGCTTTTATGAGAATCGCAAAAACGTGTTTAGCGCAGAAGATATTAGCACCGCAATTCCGCATCGTAT
TGTGCAGGATAATTTCCCGAAATTCAAAGAGAACTGCCACATTTTTACCCGTCTGATTACCGCAGTTCC
GAGCCTGCGTGAACATTTTGAAAACGTTAAAAAAGCCATCGGCATCTTTGTTAGCACCAGCATTGAAG
AAGTTTTTAGCTTCCCGTTTTACAATCAGCTGCTGACCCAGACCCAGATTGATCTGTATAACCAACTGC
TGGGTGGTATTAGCCGTGAAGCAGGCACCGAAAAAATCAAAGGTCTGAATGAAGTGCTGAATCTGGC
CATTCAGAAAAATGATGAAACCGCACATATTATTGCAAGCCTGCCGCATCGTTTTATTCCGCTGTTCAA
ACAAATTCTGAGCGATCGTAATACCCTGAGCTTTATTCTGGAAGAATTCAAATCCGATGAAGAGGTGA
TTCAGAGCTTTTGCAAATACAAAACGCTGCTGCGCAATGAAAATGTTCTGGAAACTGCCGAAGCACTG
TTTAACGAACTGAATAGCATTGATCTGACCCACATCTTTATCAGCCACAAAAAACTGGAAACCATTTC
AAGCGCACTGTGTGATCATTGGGATACCCTGCGTAATGCCCTGTATGAACGTCGTATTAGCGAACTGA
CCGGTAAAATTACCAAAAGCGCGAAAGAAAAGTTCAGCGCAGTCTGAAACATGAGGATATTAATCT
GCAAGAGATTATTAGCGCAGCCGGTAAAGAACTGTCAGAAGCATTTAAACAGAAAACCAGCGAAATT
CTGTCACATGCACATGCAGCACTGGATCAGCCGCTGCCGACCACCCTGAAAAAACAAGAAGAAAAG
AAATCCTGAAAGCCAGCTGGATAGCCTGCTGGGTCTGTATCATCTGCTGGACTGGTTTGCAGTTGAT
GAAAGCAATGAAGTTGATCCGGAATTTAGCGCACGTCTGACCGGCATTAAACTGGAAATGGAACCGA
GCCTGAGCTTTTATAACAAAGCCCGTAATTATGCCACCAAAAAACCGTATAGCGTCGAAAAATTCAAA
CTGAACTTTCAGATGCCGACCCTGGCAAGCGGTTGGGATGTTAATAAAGAAAAAAACAACGGTGCCAT
CCTGTTCGTGAAAAATGGCCTGTATTATCTGGGTATTATGCCGAAACAGAAAGGTCGTTATAAAGCGC
TGAGCTTTGAACCGACGGAAAAAACCAGTGAAGGTTTTGATAAAATGTACTACGACTATTTCCGGAT
GCAGCCAAAATGATTCCGAAATGTAGCACCCAGCTGAAAGCAGTTACCGCACATTTTCAGACCCATAC
CACCCCGATTCTGCTGAGCAATAACTTTATTGAACCGCTGGAAATCACCAAAGAGATCTACGATCTGA
ATAACCCGGAAAAAGAGCCGAAAAAATTCCAGACCGCATATGCAAAAAAAACCGGTGATCAGAAAG

FIG 62 (cont'd)

GTTATCGTGAAGCGCTGTGTAAATGGATTGATTTCACCCGTGATTTTCTGAGCAAATACACCAAAACC
ACCAGTATCGATCTGAGCAGCCTGCGTCCGAGCAGCCAGTATAAAGATCTGGGCGAATATTATGCAGA
ACTGAATCCGCTGCTGTATCATATTAGCTTTCAGCGTATTGCCGAGAAAGAAATCATGGACGCAGTTG
AAACCGGTAAACTGTACCTGTTCCAGATCTACAATAAAGATTTTGCCAAAGGCCATCATGGCAAACCG
AATCTGCATACCCTGTATTGGACCGGTCTGTTTAGCCCTGAAAATCTGGCAAAAACCTCGATTAAACTG
AATGGTCAGGCGGAACTGTTTTATCGTCCGAAAAGCCGTATGAAACGTATGGCACATCGTCTGGGTGA
AAAAATGCTGAACAAAAAACTGAAAGACCAGAAAACCCCGATCCCGGATACACTGTATCAAGAACTG
TATGATTATGTGAACCATCGTCTGAGCCATGATCTGAGTGATGAAGCACGTGCCCTGCTGCCGAATGTT
ATTACCAAAGAAGTTAGCCACGAGATCATTAAAGATCGTCGTTTTACCAGCGACAAATTCTTTTTTCAT
GTGCCGATTACCCTGAATTATCAGGCAGCAAATAGCCCGAGCAAATTTAACCAGCGTGTTAATGCATA
TCTGAAAGAACATCCAGAAACGCCGATTATTGGTATTGATCGTGGTGAACGTAACCTGATTTATATCA
CCGTTATTGATAGCACCGGCAAAATCCTGGAACAGCGTAGCCTGAATACCATTCAGCAGTTTGATTAC
CAGAAAAAACTGGATAATCGCGAGAAAGAACGTGTTGCAGCACGTCAGGCATGGTCAGTTGTTGGTA
CAATTAAAGACCTGAAACAGGGTTATCTGAGCCAGGTTATTCATGAAATTGTGGATCTGATGATTCAC
TATCAGGCCGTTGTTGTGCTGGAAAACCTGAATTTTGGCTTTAAAAGCAAACGTACCGGCATTGCAGA
AAAAGCAGTTTATCAGCAGTTCGAGAAAATGCTGATTGACAAACTGAATTGCCTGGTGCTGAAAGATT
ATCCGGCTGAAAAAGTTGGTGGTGTTCTGAATCCGTATCAGCTGACCGATCAGTTTACCAGCTTTGCAA
AAATGGGCACCCAGAGCGGATTTCTGTTTTATGTTCCGGCACCGTATACGAGCAAAATTGATCCGCTG
ACCGGTTTTGTTGATCCGTTTGTTTGGAAAACCATCAAAAACCATGAAAGCCGCAAACATTTTCTGGA
AGGTTTCGATTTTCTGCATTACGACGTTAAAACGGGTGATTTCATCCTGCACTTTAAAATGAATCGCAA
TCTGAGTTTTCAGCGTGGCCTGCCTGGTTTTATGCCTGCATGGGATATTGTGTTTGAGAAAAACGAAAC
ACAGTTCGATGCAAAAGGCACCCCGTTTATTGCAGGTAAACGTATTGTTCCGGTGATTGAAAATCATC
GTTTCACCGGTCGTTATCGCGATCTGTATCCGGCAAATGAACTGATCGCACTGCTGGAAGAGAAAGGT
ATTGTTTTTCGTGATGGCTCAAACATTCTGCCGAAACTGCTGGAAAATGATGATAGCCATGCAATTGAT
ACCATGGTTGCACTGATTCGTAGCGTTCTGCAGATGCGTAATAGCAATGCAGCAACCGGTGAAGATTA
CATTAATAGTCCGGTTCGTGATCTGAATGGTGTTTGTTTTGATAGCCGTTTTCAGAATCCGGAATGGCC
GATGGATGCAGATGCAAATGGTGCATATCATATTGCACTGAAAGGACAGCTGCTGCTGAACCACCTGA
AGAAAGCAAAGATCTGAAACTGCAAAACGGCATTAGCAATCAGGATTGGCTGGCATATATCCAAGA
ACTGCGTAACCCTAAAAAAAAACGCAAAGTGAAGCTTGCGGCCGCACTCGAG<u>CACCACCACCACCAC
CAC</u>

SYSTEMS AND METHODS FOR THE TREATMENT OF HEMOGLOBINOPATHIES

REFERENCE TO RELATED APPLICATIONS

The present application is a continuation of International Application No. PCT/US2019/022374, filed Mar. 14, 2019, which claims the benefit of United States Provisional Application Nos. 62/643,168, filed Mar. 14, 2018, 62/767,488, filed Nov. 14, 2018, and 62/773,073, filed Nov. 29, 2018, the contents of which are hereby incorporated by reference in their entirety.

SEQUENCE LISTING

This application contains a Sequence Listing, which was submitted in ASCII format via EFS-Web, and is hereby incorporated by reference in its entirety. The ASCII copy, created on Apr. 2, 2024, is named SecondSubstituteSequenceListing.txt and is 813 KB in size.

FIELD

This disclosure relates to genome editing systems and methods for altering a target nucleic acid sequence, or modulating expression of a target nucleic acid sequence, and applications thereof in connection with the alteration of genes encoding hemoglobin subunits and/or treatment of hemoglobinopathies.

BACKGROUND

Hemoglobin (Hb) carries oxygen in erythrocytes or red blood cells (RBCs) from the lungs to tissues. During prenatal development and until shortly after birth, hemoglobin is present in the form of fetal hemoglobin (HbF), a tetrameric protein composed of two alpha ($\alpha$)-globin chains and two gamma ($\gamma$)-globin chains. HbF is largely replaced by adult hemoglobin (HbA), a tetrameric protein in which the $\gamma$-globin chains of HbF are replaced with beta ($\beta$)-globin chains, through a process known as globin switching. The average adult makes less than 1% HbF out of total hemoglobin (Thein 2009). The $\alpha$-hemoglobin gene is located on chromosome 16, while the $\beta$-hemoglobin gene (HBB), A gamma (A$\gamma$)-globin chain (HBG1, also known as gamma globin A), and G gamma (G$\gamma$)-globin chain (HBG2, also known as gamma globin G) are located on chromosome 11 within the globin gene cluster (also referred to as the globin locus).

Mutations in HBB can cause hemoglobin disorders (i.e., hemoglobinopathies) including sickle cell disease (SCD) and beta-thalassemia ($\beta$-Thal). Approximately 93,000 people in the United States are diagnosed with a hemoglobinopathy. Worldwide, 300,000 children are born with hemoglobinopathies every year (Angastiniotis 1998). Because these conditions are associated with HBB mutations, their symptoms typically do not manifest until after globin switching from HbF to HbA.

SCD is the most common inherited hematologic disease in the United States, affecting approximately 80,000 people (Brousseau 2010). SCD is most common in people of African ancestry, for whom the prevalence of SCD is 1 in 500. In Africa, the prevalence of SCD is 15 million (Aliyu 2008). SCD is also more common in people of Indian, Saudi Arabian and Mediterranean descent. In those of Hispanic-American descent, the prevalence of sickle cell disease is 1 in 1,000 (Lewis 2014).

SCD is caused by a single homozygous mutation in the HBB gene, c.17A>T (HbS mutation). The sickle mutation is a point mutation (GAG>GTG) on HBB that results in substitution of valine for glutamic acid at amino acid position 6 in exon 1. The valine at position 6 of the $\beta$-hemoglobin chain is hydrophobic and causes a change in conformation of the $\beta$-globin protein when it is not bound to oxygen. This change of conformation causes HbS proteins to polymerize in the absence of oxygen, leading to deformation (i.e., sickling) of RBCs. SCD is inherited in an autosomal recessive manner, so that only patients with two HbS alleles have the disease. Heterozygous subjects have sickle cell trait, and may suffer from anemia and/or painful crises if they are severely dehydrated or oxygen deprived.

Sickle shaped RBCs cause multiple symptoms, including anemia, sickle cell crises, vaso-occlusive crises, aplastic crises, and acute chest syndrome. Sickle shaped RBCs are less elastic than wild-type RBCs and therefore cannot pass as easily through capillary beds and cause occlusion and ischemia (i.e., vaso-occlusion). Vaso-occlusive crisis occurs when sickle cells obstruct blood flow in the capillary bed of an organ leading to pain, ischemia, and necrosis. These episodes typically last 5-7 days. The spleen plays a role in clearing dysfunctional RBCs, and is therefore typically enlarged during early childhood and subject to frequent vaso-occlusive crises. By the end of childhood, the spleen in SCD patients is often infarcted, which leads to autosplenectomy. Hemolysis is a constant feature of SCD and causes anemia. Sickle cells survive for 10-20 days in circulation, while healthy RBCs survive for 90-120 days. SCD subjects are transfused as necessary to maintain adequate hemoglobin levels. Frequent transfusions place subjects at risk for infection with HIV, Hepatitis B, and Hepatitis C. Subjects may also suffer from acute chest crises and infarcts of extremities, end organs, and the central nervous system.

Subjects with SCD have decreased life expectancies. The prognosis for patients with SCD is steadily improving with careful, life-long management of crises and anemia. As of 2001, the average life expectancy of subjects with sickle cell disease was the mid-to-late 50's. Current treatments for SCD involve hydration and pain management during crises, and transfusions as needed to correct anemia.

Thalassemias (e.g., $\beta$-Thal, $\delta$-Thal, and $\beta/\delta$-Thal) cause chronic anemia. $\beta$-Thal is estimated to affect approximately 1 in 100,000 people worldwide. Its prevalence is higher in certain populations, including those of European descent, where its prevalence is approximately 1 in 10,000. $\beta$-Thal major, the more severe form of the disease, is life-threatening unless treated with lifelong blood transfusions and chelation therapy. In the United States, there are approximately 3,000 subjects with $\beta$-Thal major. $\beta$-Thal intermedia does not require blood transfusions, but it may cause growth delay and significant systemic abnormalities, and it frequently requires lifelong chelation therapy. Although HbA makes up the majority of hemoglobin in adult RBCs, approximately 3% of adult hemoglobin is in the form of HbA2, an HbA variant in which the two $\gamma$-globin chains are replaced with two delta ($\Delta$)-globin chains. $\delta$-Thal is associated with mutations in the A hemoglobin gene (HBD) that cause a loss of HBD expression. Co-inheritance of the HBD mutation can mask a diagnosis of $\beta$-Thal (i.e., $\beta/\delta$-Thal) by decreasing the level of HbA2 to the normal range (Bouva 2006). $\beta/\delta$-Thal is usually caused by deletion of the HBB and HBD sequences in both alleles. In homozygous ($\delta o/\delta o$ $\beta o/\beta o$) patients, HBG is expressed, leading to production of HbF alone.

Like SCD, β-Thal is caused by mutations in the HBB gene. The most common HBB mutations leading to β-Thal are: c.-136C>G, c.92+1G>A, c.92+6T>C, c.93-21G>A, c.118C>T, c.316-106C>G, c.25_26delAA, c.27_28insG, c.92+5G>C, c.118C>T, c.135delC, c.315+1G>A, c.-78A>G, c.52A>T, c.59A>G, c.92+5G>C, c.124_127delTTCT, c.316-197C>T, c.-78A>G, c.52A>T, c.124_127delTTCT, c.316-197C>T, c.-138C>T, c.-79A>G, c.92+5G>C, c.75T>A, c.316-2A>G, and c.316-2A>C. These and other mutations associated with β-Thal cause mutated or absent β-globin chains, which causes a disruption of the normal Hb α-hemoglobin to β-hemoglobin ratio. Excess α-globin chains precipitate in erythroid precursors in the bone marrow.

In β-Thal major, both alleles of HBB contain nonsense, frameshift, or splicing mutations that leads to complete absence of β-globin production (denoted $β^0/β^0$). β-Thal major results in severe reduction in β-globin chains, leading to significant precipitation of α-globin chains in RBCs and more severe anemia.

β-Thal intermedia results from mutations in the 5' or 3' untranslated region of HBB, mutations in the promoter region or polyadenylation signal of HBB, or splicing mutations within the HBB gene. Patient genotypes are denoted βo/β+ or β+/β+. βo represents absent expression of a β-globin chain; β+ represents a dysfunctional but present β-globin chain. Phenotypic expression varies among patients. Since there is some production of β-globin, β-Thal intermedia results in less precipitation of α-globin chains in the erythroid precursors and less severe anemia than β-Thal major. However, there are more significant consequences of erythroid lineage expansion secondary to chronic anemia.

Subjects with β-Thal major present between the ages of 6 months and 2 years, and suffer from failure to thrive, fevers, hepatosplenomegaly, and diarrhea. Adequate treatment includes regular transfusions. Therapy for β-Thal major also includes splenectomy and treatment with hydroxyurea. If patients are regularly transfused, they will develop normally until the beginning of the second decade. At that time, they require chelation therapy (in addition to continued transfusions) to prevent complications of iron overload. Iron overload may manifest as growth delay or delay of sexual maturation. In adulthood, inadequate chelation therapy may lead to cardiomyopathy, cardiac arrhythmias, hepatic fibrosis and/or cirrhosis, diabetes, thyroid and parathyroid abnormalities, thrombosis, and osteoporosis. Frequent transfusions also put subjects at risk for infection with HIV, hepatitis B and hepatitis C.

β-Thal intermedia subjects generally present between the ages of 2-6 years. They do not generally require blood transfusions. However, bone abnormalities occur due to chronic hypertrophy of the erythroid lineage to compensate for chronic anemia. Subjects may have fractures of the long bones due to osteoporosis. Extramedullary erythropoiesis is common and leads to enlargement of the spleen, liver, and lymph nodes. It may also cause spinal cord compression and neurologic problems. Subjects also suffer from lower extremity ulcers and are at increased risk for thrombotic events, including stroke, pulmonary embolism, and deep vein thrombosis. Treatment of β-Thal intermedia includes splenectomy, folic acid supplementation, hydroxyurea therapy, and radiotherapy for extramedullary masses. Chelation therapy is used in subjects who develop iron overload.

Life expectancy is often diminished in β-Thal patients. Subjects with β-Thal major who do not receive transfusion therapy generally die in their second or third decade. Subjects with β-Thal major who receive regular transfusions and adequate chelation therapy can live into their fifth decade and beyond. Cardiac failure secondary to iron toxicity is the leading cause of death in β-Thal major subjects due to iron toxicity.

A variety of new treatments are currently in development for SCD and β-Thal. Delivery of an anti-sickling HBB gene via gene therapy is currently being investigated in clinical trials. However, the long-term efficacy and safety of this approach is unknown. Transplantation with hematopoietic stem cells (HSCs) from an HLA-matched allogeneic stem cell donor has been demonstrated to cure SCD and β-Thal, but this procedure involves risks including those associated with ablation therapy, which is required to prepare the subject for transplant, increases risk of life-threatening opportunistic infections, and risk of graft vs. host disease after transplantation. In addition, matched allogeneic donors often cannot be identified. Thus, there is a need for improved methods of managing these and other hemoglobinopathies.

SUMMARY

Provided herein are genome editing systems, ribonucleoprotein (RNP) complexes, guide RNAs, Cpf1 proteins, including modified Cpf1 proteins (Cpf1 variants), and CRISPR-mediated methods for altering the promoter region of one or more γ-globin genes (e.g., HBG1, HBG2, or HBG1 and HBG2) and increasing expression of fetal hemoglobin (HbF). In certain embodiments, an RNP complex may include a guide RNA (gRNA) complexed to a wild-type Cpf1 or modified Cpf1 RNA-guided nuclease (modified Cpf1 protein). In certain embodiments, a gRNA may comprise a sequence set forth in Table 13, Table 18, or Table 19. In certain embodiments, a gRNA may comprise a gRNA targeting domain. In certain embodiments, a gRNA targeting domain may comprise a sequence selected from the group consisting of SEQ ID NOs:1002, 1254, 1258, 1260, 1262, and 1264. In certain embodiments, a gRNA may comprise a gRNA sequence set forth in Table 19. In certain embodiments, a gRNA may comprise a sequence selected from the group consisting of SEQ ID NOs:1022, 1023, 1041-1105. In certain embodiments, the RNP complex may comprise an RNP complex set forth in Table 21. For example, an RNP complex may include a gRNA comprising the sequence set forth in SEQ ID NO:1051 and a modified Cpf1 protein encoded by the sequence set forth in SEQ ID NO: 1097 (RNP32, Table 21).

The inventors have discovered herein that delivery of an RNP complex including a gRNA complexed to a modified Cpf1 protein may result in increased editing of a target nucleic acid. In certain embodiments, the modified Cpf1 protein may contain one or more modifications. In certain embodiments, the one or more modifications may include, without limitation, one or more mutations in a wild-type Cpf1 amino acid sequence, one or more mutations in a wild-type Cpf1 nucleic acid sequence, one or more nuclear localization signals (NLS), one or more purification tags (e.g., His tag), or a combination thereof. In certain embodiments, a modified Cpf1 may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, the gRNA may be a modified or unmodified gRNA. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO: 1097 (RNP32, Table 21). In certain embodiments, an RNP complex comprising a modified Cpf1 protein may increase editing of a target nucleic acid. In certain embodiments, an RNP complex comprising a modified Cpf1 protein may increase editing resulting in an increase of productive indels. In various embodiments, an increase in editing of the target nucleic acid may be assessed by any means known to skilled artisans, such as, but not limited to, PCR amplification of the target nucleic acid and subsequent sequencing analysis (e.g., Sanger sequencing, next generation sequencing).

The inventors have also discovered herein that delivery of an RNP complex including a modified gRNA complexed to an unmodified or modified Cpf1 protein may result in increased editing of a target nucleic acid. In certain embodiments, the modified gRNA may comprise one or more modifications including a phosphorothioate linkage modification, a phosphorodithioate (PS2) linkage modification, a 2'-O-methyl modification, one or more or a stretch of deoxyribonucleic acid (DNA) bases (also referred to herein as a "DNA extension"), one or more or a stretch of ribonucleic acid (RNA) bases (also referred to herein as a "RNA extension"), or combinations thereof. In certain embodiments, the DNA extension may comprise a sequence set forth in Table 24. For example, in certain embodiments, the DNA extension may comprise a sequence set forth in SEQ ID NOs:1235-1250. In certain embodiments, the RNA extension may comprise a sequence set forth in Table 24. For example, in certain embodiments, the RNA extension may comprise a sequence set forth in SEQ ID NOs:1231-1234, 1251-1253. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO: 1097 (RNP32, Table 21). In certain embodiments, an RNP complex comprising a modified gRNA may increase editing of a target nucleic acid. In certain embodiments, an RNP complex comprising a modified gRNA may increase editing resulting in an increase of productive indels.

In certain embodiments, an RNP complex comprising a modified gRNA and a modified Cpf1 protein may increase editing of a target nucleic acid. In certain embodiments, an RNP complex comprising a modified gRNA and a modified Cpf1 protein may increase editing resulting in an increase of productive indels.

The inventors have also discovered that codelivery of an RNP complex comprising a gRNA complexed to a Cpf1 molecule (e.g., "gRNA-Cpf1-RNP") with a "booster element" may result in increased editing of a target nucleic acid. In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO: 1097 (RNP32, Table 21). As used herein, the term "booster element" refers to an element which, when co-delivered with a RNP complex comprising a gRNA complexed to an RNA-guided nuclease ("gRNA-nuclease-RNP"), increases editing of a target nucleic acid compared with editing of the target nucleic acid without the booster element. In certain embodiments, one or more booster elements may be codelivered with a gRNA-nuclease-RNP complex to increase editing of a target nucleic acid. In certain embodiments, codelivery of a booster element may increase editing resulting in an increase of productive indels. In various embodiments, an increase in editing of the target nucleic acid may be assessed by any means known to skilled artisans, such as, but not limited to, PCR amplification of the target nucleic acid and subsequent sequencing analysis (e.g., Sanger sequencing, next generation sequencing).

In certain embodiments, a gRNA-nuclease-RNP may comprise a gRNA-Cpf1-RNP. In certain embodiments, a Cpf1 molecule of the gRNA-Cpf1-RNP complex may be a wild-type Cpf1 or modified Cpf1. In certain embodiments, the Cpf1 molecule of the gRNA-Cpf1-RNP may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, the gRNA-Cpf1-RNP complex may comprise a gRNA comprising a targeting domain set forth in Table 13 or Table 18. In certain embodiments, the gRNA-Cpf1-RNP complex may comprise a gRNA comprising a sequence set forth in Table 19. In certain embodiments, the gRNA may be a modified or unmodified gRNA.

In certain embodiments, a booster element may comprise a dead RNP comprising a dead gRNA molecule complexed with an RNA-guided nuclease molecule ("dead gRNA-nuclease-RNP"). In certain embodiments, the dead gRNA-nuclease-RNP may comprise a dead gRNA complexed with a wild-type (WT) Cas9 molecule ("dead gRNA-Cas9-RNP"), a dead gRNA complexed with a Cas9 nickase molecule ("dead gRNA-nickase-RNP") or a dead gRNA complexed with an enzymatically inactive (ei) Cas9 molecule ("dead gRNA-eiCas9-RNP"). In certain embodiments, the dead gRNA-nuclease-RNP complex may have decreased activity or lack nuclease activity. In certain embodiments, the dead gRNA of the dead gRNA-nuclease-RNP complex may comprise any of the dead gRNAs set forth herein. For example, the dead gRNA may comprise a targeting domain may be the same as or may differ by no more than 3 nucleotides from a dead gRNA targeting domain set forth in Table 10 or Table 15. In certain embodiments, the dead gRNA may include a targeting domain comprising a truncation of a gRNA targeting domain. In certain embodiments, the gRNA targeting domain to be truncated may be a gRNA targeting domain set forth in Table 2, Table 10, or Table 15. In certain embodiments, the dead gRNA may be a modified or unmodified dead gRNA. As shown herein, codelivery of a gRNA-Cpf1-RNP with a dead gRNA-Cas9-RNP (i.e., an RNP comprising a dead gRNA complexed to a WT Cas9) or codelivery of a gRNA-Cpf1-RNP with a dead gRNA-nickase-RNP (i.e., an RNP comprising a dead gRNA complexed to a Cas9 nickase (i.e., the Cas9 D10A nickase)) resulted in an increase in total editing above levels observed following delivery of gRNA-Cpf1-RNP alone (see, e.g., Examples, 15, 17, 18). Dead gRNA molecules may comprise targeting domains complementary to regions proximal to or within a target region (e.g., the CCAAT box target region, 13 nt target region, proximal HBG1/2 promoter target sequence, and/or the GATA1 binding motif in BCL11Ae) in a target nucleic acid. In certain embodiments, "proximal to" may denote the region within 10, 25, 50, 100, or 200 nucleotides of a target region (e.g., the CCAAT box target region, 13 nt target region, proximal HBG1/2 promoter target sequence, and/or the GATA1 binding motif in BCL11Ae). In certain embodiments, one or more booster elements may be comprised of one or more dead gRNA-nuclease-RNPs, e.g., dead gRNA-Cas9-RNP, dead gRNA-nickase-RNP, dead gRNA-eiCas9-

RNP, to be codelivered with a gRNA-Cpf1-RNP. In certain embodiments, codelivery of a dead gRNA-nuclease-RNP does not alter the indel profile of a gRNA-Cpf1-RNP.

In certain embodiments, a booster element may comprise an RNP complex comprising a gRNA molecule complexed with an RNA-guided nuclease nickase molecule ("gRNA-nickase-RNP"). In certain embodiments, the RNA-guided nuclease nickase molecule may be a Cas9 nickase molecule, e.g., Cas9 D10A nickase. In certain embodiments, the gRNA of the gRNA-nickase-RNP may comprise any of the gRNAs set forth herein. For example, the gRNA may comprise a gRNA targeting domain set forth in Table 2, Table 10, or Table 15. In certain embodiments, the gRNA may be a modified or unmodified gRNA. As shown herein, codelivery of gRNA-Cpf1-RNP with a gRNA-nickase-RNP complex (RNP comprising a guide RNA complexed to a Cas9D10A nickase molecule) resulted in an increase in total editing above levels observed following delivery of gRNA-Cpf1-RNP alone (see, e.g., Examples 15, 16). Additionally, codelivery of a gRNA-nickase-RNP complex with a gRNA-Cpf1-RNP complex altered the directionality, length, and/or position of the indel profile of gRNA-Cpf1-RNP. In certain embodiments, a booster enhancer may be used to provide a desired editing outcome, for example, to increase the rate of productive indels. In certain embodiments, codelivery of a gRNA-nickase-RNP complex with a gRNA-Cpf1-RNP complex may alter the indel profile of the gRNA-Cpf1-RNP.

In certain embodiments, a booster element may comprise a single stranded oligodeoxynucleotide (ssODN) or a double stranded oligodeoxynucleotide (dsODN). In certain embodiments, the ssODN may be any ssODN disclosed herein. In certain embodiments, an ssODN may comprise a sequence set forth in Table 11. For example, in certain embodiments, an ssODN may comprise the sequence set forth in SEQ ID NO:1040.

In one aspect, the disclosure relates to an RNP complex comprising a CRISPR from *Prevotella* and Franciscella 1 (Cpf1) RNA-guided nuclease or a variant thereof and a gRNA, wherein the gRNA is capable of binding to a target site in a promoter of an HBG gene in a cell. In certain embodiments, the gRNA may be modified or unmodified. In certain embodiments, the gRNA may comprise one or more modifications including a phosphorothioate linkage modification, a phosphorodithioate (PS2) linkage modification, a 2'-O-methyl modification, a DNA extension, an RNA extension, or combinations thereof. In certain embodiments, the DNA extension may comprise a sequence set forth in Table 24. In certain embodiments, the RNA extension may comprise a sequence set forth in Table 24. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a Cpf1 variant protein encoded by the sequence set forth in SEQ ID NO:1097 (RNP32, Table 21). In certain embodiments, the Cpf1 variant protein may contain one or more modifications. In certain embodiments, the one or more modifications may include, without limitation, one or more mutations in a wild-type Cpf1 amino acid sequence, one or more mutations in a wild-type Cpf1 nucleic acid sequence, one or more nuclear localization signals (NLS), one or more purification tags (e.g., His tag), or a combination thereof. In certain embodiments, a Cpf1 variant protein may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences).

In one aspect, the disclosure relates to a method of altering a promoter of an HBG gene in a cell comprising contacting the cell with an RNP complex disclosed herein. In certain embodiments, the alteration may comprise an indel within one or more regions set forth in Table 17. In certain embodiments, the alteration may comprise an indel within a CCAAT box target region of the promoter of an HBG gene. For example, in certain embodiments, the alteration may comprise an indel within Chr 11 (NC_000011.10): 5,249,955-5,249,987 (Table 17, Region 6), Chr 11 (NC_000011.10): 5,254,879-5,254,909 (Table 17, Region 16), or a combination thereof. In certain embodiments, the RNP complex may comprise a gRNA and a Cpf1 protein. In certain embodiments, the gRNA may comprise an RNA targeting domain set forth in Table 19. In certain embodiments, the gRNA targeting domain may comprise a sequence selected from the group consisting of SEQ ID NOs:1002, 1254, 1258, 1260, 1262, and 1264. In certain embodiments, the gRNA may comprise a gRNA sequence set forth in Table 19. In certain embodiments, the gRNA may comprise a sequence selected from the group consisting of SEQ ID NOs:1022, 1023, 1041-1105. In certain embodiments, a gRNA may be configured to provide an editing event at Chr11:5249973, Chr11:5249977 (HBG1); Chr11:5250042, Chr11:5250046 (HBG1); Chr11:5250055, Chr11:5250059 (HBG1); Chr11:5250179, Chr11:5250183 (HBG1); Chr11:5254897, Chr11:5254901 (HBG2); Chr11:5254897, Chr11:5254901 (HBG2); Chr11:5254966, 5254970 (HBG2); Chr11:5254979, 5254983 (HBG2) (Table 22, Table 23). In certain embodiments, the cell may be further contacted with a booster element. In certain embodiment, a booster element may comprise a single stranded oligodeoxynucleotide (ssODN) or a double stranded oligodeoxynucleotide (dsODN). In certain embodiments, the ssODN may be any ssODN disclosed herein. In certain embodiments, an ssODN may comprise a sequence set forth in Table 11. For example, in certain embodiments, an ssODN may comprise the sequence set forth in SEQ ID NO: 1040.

In one aspect, the disclosure relates to an isolated cell comprising an alteration in a promoter of HBG gene generated by the delivery of an RNP complex to the cell. In certain embodiments, the RNP complex may comprise a gRNA and a Cpf1 protein. In certain embodiments, the gRNA may be modified or unmodified. In certain embodiments, the gRNA may comprise one or more modifications including a phosphorothioate linkage modification, a phosphorodithioate (PS2) linkage modification, a 2'-O-methyl modification, a DNA extension, an RNA extension, or combinations thereof. In certain embodiments, the DNA extension may comprise a sequence set forth in Table 24. In certain embodiments, the RNA extension may comprise a sequence set forth in Table 24. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a Cpf1 variant protein encoded by the sequence set forth in SEQ ID NO:1097 (RNP32, Table 21). In certain embodiments, the Cpf1 variant protein may contain one or more modifications. In certain embodiments, the one or more modifications may include, without limitation, one or more mutations in a wild-type Cpf1 amino acid sequence, one or more mutations in a wild-type Cpf1 nucleic acid sequence, one or more nuclear localization signals (NLS), one or more purification tags (e.g., His tag), or a combination thereof. In certain embodiments, a Cpf1 variant protein may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, a booster element may be co-delivered with the RNP complex. In certain embodiment, a booster element may comprise a single stranded oligodeoxynucleotide (ssODN) or a double stranded oligodeoxynucleotide (dsODN). In certain embodiments, the ssODN may be any ssODN disclosed herein. In certain embodiments, an ssODN may comprise a sequence set forth in Table 11. For example, in certain embodiments, an ssODN may comprise the sequence set forth in SEQ ID NO: 1040.

In one aspect, the disclosure relates to an ex vivo method of increasing the level of fetal hemoglobin (HbF) in a human cell by genome editing using an RNP complex comprising a gRNA and a Cpf1 RNA-guided nuclease or a variant thereof to affect an alteration in a promoter of an HBG gene, thereby to increase expression of HbF. In certain embodiments, the gRNA may be modified or unmodified. In certain embodiments, the gRNA may comprise one or more modifications including a phosphorothioate linkage modification, a phosphorodithioate (PS2) linkage modification, a 2'-O-methyl modification, a DNA extension, an RNA extension, or combinations thereof. In certain embodiments, the DNA extension may comprise a sequence set forth in Table 24. In certain embodiments, the RNA extension may comprise a sequence set forth in Table 24. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a Cpf1 variant protein encoded by the sequence set forth in SEQ ID NO:1097 (RNP32, Table 21). In certain embodiments, the Cpf1 variant protein may contain one or more modifications. In certain embodiments, the one or more modifications may include, without limitation, one or more mutations in a wild-type Cpf1 amino acid sequence, one or more mutations in a wild-type Cpf1 nucleic acid sequence, one or more nuclear localization signals (NLS), one or more purification tags (e.g., His tag), or a combination thereof. In certain embodiments, a Cpf1 variant protein may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, a booster element may be co-delivered with the RNP complex. In certain embodiment, a booster element may comprise a single stranded oligodeoxynucleotide (ssODN) or a double stranded oligodeoxynucleotide (dsODN). In certain embodiments, the ssODN may be any ssODN disclosed herein. In certain embodiments, an ssODN may comprise a sequence set forth in Table 11. For example, in certain embodiments, an ssODN may comprise the sequence set forth in SEQ ID NO: 1040.

In one aspect, the disclosure relates to a population of CD34+ or hematopoietic stem cells, wherein one or more cells in the population comprises an alteration in a promoter of an HBG gene, which alteration is generated by delivering an RNP complex comprising a gRNA and a Cpf1 RNA-guided nuclease or a variant thereof to the population of CD34+ or hematopoietic stem cells. In certain embodiments, the gRNA may be modified or unmodified. In certain embodiments, the gRNA may comprise one or more modifications including a phosphorothioate linkage modification, a phosphorodithioate (PS2) linkage modification, a 2'-O-methyl modification, a DNA extension, an RNA extension, or combinations thereof. In certain embodiments, the DNA extension may comprise a sequence set forth in Table 24. In certain embodiments, the RNA extension may comprise a sequence set forth in Table 24. In certain embodiments, the gRNA may comprise a sequence set forth in Table 13, Table 18, or Table 19. In certain embodiments, the RNP complex may comprise an RNP complex set forth in Table 21. For example, the RNP complex may include a gRNA comprising the sequence set forth in SEQ ID NO:1051 and a Cpf1 variant protein encoded by the sequence set forth in SEQ ID NO:1097 (RNP32, Table 21). In certain embodiments, the Cpf1 variant protein may contain one or more modifications. In certain embodiments, the one or more modifications may include, without limitation, one or more mutations in a wild-type Cpf1 amino acid sequence, one or more mutations in a wild-type Cpf1 nucleic acid sequence, one or more nuclear localization signals (NLS), one or more purification tags (e.g., His tag), or a combination thereof. In certain embodiments, a Cpf1 variant protein may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, a booster element may be co-delivered with the RNP complex. In certain embodiment, a booster element may comprise a single stranded oligodeoxynucleotide (ssODN) or a double stranded oligodeoxynucleotide (dsODN). In certain embodiments, the ssODN may be any ssODN disclosed herein. In certain embodiments, an ssODN may comprise a sequence set forth in Table 11. For example, in certain embodiments, an ssODN may comprise the sequence set forth in SEQ ID NO: 1040.

In one aspect, the disclosure relates to a method of alleviating one or more symptoms of sickle cell disease in a subject in need thereof, the method comprising: a) isolating a population of CD34+ or hematopoietic stem cells from the subject; b) modifying the population of isolated cells ex vivo by delivering an RNP complex comprising a gRNA and a Cpf1 RNA-guided nuclease or a variant thereof to the population of isolated cells, thereby to affect an alteration in a promoter of an HBG gene in one or more cells in the population; and c) administering the modified population of cells to the subject, thereby to alleviate one or more symptoms of sickle cell disease in the subject. In certain embodiments, the alteration may comprise an indel within a CCAAT box target region of the promoter of the HBG gene. In certain embodiments, the RNP complex may be delivered using electroporation. In certain embodiments, at least about 5%, at least about 10%, at least about 20%, at least about 30%, at least about 40%, at least about 50%, at least about 60%, at least about 70%, at least about 80% or at least about 90% of the cells in the population of cells comprise a productive indel.

In one aspect, the disclosure relates to a gRNA comprising a 5' end and a 3' end, and comprising a DNA extension at the 5' end and a 2'-O-methyl-3'-phosphorothioate modification at the 3' end, wherein the gRNA includes an RNA segment capable of hybridizing to a target site and an RNA segment capable of associating with a Cpf1 RNA-guided nuclease. In certain embodiments, the DNA extension may comprise a sequence set forth in SEQ ID NOs:1235-1250. In certain embodiments, the gRNA may be modified or unmodified. In certain embodiments, the gRNA may comprise one or more modifications including a phosphorothioate linkage modification, a phosphorodithioate (PS2) linkage modification, a 2'-O-methyl modification, a DNA extension, an RNA extension, or combinations thereof. In certain embodiments, the DNA extension may comprise a sequence set forth in Table 24. In certain embodiments, the RNA extension may comprise a sequence set forth in Table 24. In certain embodiments, the gRNA may comprise a sequence set forth in Table 13, Table 18, or Table 19.

In one aspect, the disclosure relates to an RNP complex comprising a Cpf1 RNA-guided nuclease as disclosed herein and a gRNA as disclosed herein.

Also provided herein are genome editing systems, guide RNAs, and CRISPR-mediated methods for altering one or more γ-globin genes (e.g., HBG1, HBG2, or HBG1 and HBG2), the erythroid specific enhancer of the BCL11A gene (BCL11Ae), or a combination thereof, and increasing expression of fetal hemoglobin (HbF). In certain embodiments, one or more gRNAs comprising a sequence set forth in Table 18 or Table 19 may be used to introduce alterations in the promoter region of the HBG gene. In certain embodiments, genome editing systems, guide RNAs, and CRISPR-mediated methods may alter a 13 nucleotide (nt) target region that is 5' of the transcription site of the HBG1, HBG2, or HBG1 and HBG2 gene ("13 nt target region"). In certain embodiments, genome editing systems, guide RNAs, and CRISPR-mediated methods may alter a CCAAT box target region that is 5' of the transcription site of the HBG1, HBG2, or HBG1 and HBG2 gene ("CCAAT box target region"). In certain embodiments, the CCAAT box target region may be the region that is at or near the distal CCAAT box and includes the nucleotides of the distal CCAAT box and 25 nucleotides upstream (5') and 25 nucleotides downstream (3') of the distal CCAAT box (i.e., HBG1/2 c.-86 to -140). In certain embodiments, the CCAAT box target region may be the region that is at or near the distal CCAAT box and includes the nucleotides of the distal CCAAT box and 5 nucleotides upstream (5') and 5 nucleotides downstream (3') of the distal CCAAT box (i.e., HBG1/2 c.-106 to -120). In certain embodiments, the CCAAT box target region may comprise a 18 nt target region, a 13 nt target region, a 11 nt target region, a 4 nt target region, a 1 nt target region, a −117G>A target region, or a combination thereof as disclosed herein. In certain embodiments, the alteration may be a 18 nt deletion, 13 nt deletion, 11 nt deletion, 4 nt deletion, 1 nt deletion, a substitution from G to A at c.-117 of the HBG1, HBG2, or HBG1 and HBG2 gene, or a combination thereof. In certain embodiments, the alteration may be a non-naturally occurring alteration or a naturally occurring alteration. In certain embodiments, one or more gRNAs comprising a targeting domain set forth in SEQ ID NOs: 251-901 or 940-942 may be used to introduce alterations in the 13 nt target region. In certain embodiments, one or more gRNAs comprising a sequence set forth in SEQ ID NOs: 251-901, 940-942, 996, 997, 970, 971, 1002, or 1003 may be used to introduce alterations in the CCAAT box target region. In certain embodiments, genome editing systems, guide RNAs, and CRISPR-mediated methods may alter a GATA1 binding motif in BCL11Ae that is in the +58 DNase I hypersensitive site (DHS) region of intron 2 of the BCL11A gene ("GATA1 binding motif in BCL11Ae"). In certain embodiments, one or more gRNAs comprising a targeting domain set forth in SEQ ID NOs:952-955 may be used to introduce alterations in the GATA1 binding motif in BCL11Ae. In certain embodiments, one or more gRNAs may be used to introduce alterations in the GATA1 binding motif in BCL11Ae and one or more gRNAs may be used to introduce alterations in the 13 nt target region of HBG1 and/or HBG2.

Also provided herein in certain embodiments are the use of optional genome editing system components such as template nucleic acids (oligonucleotide donor templates). In certain embodiments, template nucleic acids for use in targeting the CCAAT target region may include, without limitation, template nucleic acids encoding alterations of the CCAAT box target region. In certain embodiments, the CCAAT box target region may comprise a 18 nt target region, a 11 nt target region, a 4 nt target region, a 1 nt target region, or a combination thereof. In certain embodiments, the template nucleic acid may be a single stranded oligodeoxynucleotide (ssODN) or a double stranded oligodeoxynucleotide (dsODN). In certain embodiments, 5' and 3' homology arms, and exemplary full-length donor templates encoding alterations at the CCAAT box target region are also presented below (e.g., SEQ ID NOS: 904-909, 974-995). In certain embodiments, the template nucleic acid may be a positive strand or a negative strand. In certain embodiments, the ssODN may comprise a 5' homology arm, a replacement sequence, and a 3' homology arm. In certain embodiments, the 5' homology arm may be about 25 to about 200 nucleotides or more in length, e.g., at least about 25, 50, 75, 100, 125, 150, 175, or 200 nucleotides in length; the replacement sequence may comprise 0 nucleotides in length; and the 3' homology arm may be about 25 to about 200 nucleotides or more in length, e.g., at least about 25, 50, 75, 100, 125, 150, 175, or 200 nucleotides in length. In certain embodiments, the ssODN may comprise one or more phosphorothioates.

In certain embodiments, the genome editing systems, guide RNAs, and CRISPR-mediated methods for altering one or more γ-globin genes (e.g., HBG1, HBG2, or HBG1 and HBG2), may include an RNA-guided nuclease. In certain embodiments, the RNA-guided nuclease may a Cas9 or modified Cas 9. In certain embodiments, the RNA-guided nuclease may a Cpf1 or modified Cpf1 as disclosed herein.

In one aspect, the disclosure relates to compositions including a plurality of cells generated by the methods disclosed above, in which at least 20%, 30%, 40%, 50%, 60%, 70%, 80% or 90% of the cells include an alteration of a sequence of a 13 nt target region of the human HBG1 or HBG2 gene or a plurality of cells generated by the methods disclosed above, wherein at least 20%, 30%, 40%, 50%, 60%, 70%, 80% or 90% of the cells include an alteration of a sequence of a 13 nt target region of the human HBG1 or HBG2 gene and at least 20%, 30%, 40%, 50%, 60%, 70%, 80% or 90% of the cells include an alteration of a sequence of the GATA1 binding motif in BCL11Ae. In certain embodiments, at least a portion of the plurality of cells may be within an erythroid lineage. In certain embodiments, the plurality of cells may be characterized by an increased level of fetal hemoglobin expression relative to an unmodified plurality of cells. In certain embodiments, the level of fetal hemoglobin may be increased by at least 20%, 30%, 40%, 50%, 60%, 70%, 80% or 90%. In certain embodiments, the compositions may further include a pharmaceutically acceptable carrier.

In one aspect, the disclosure relates to a method of altering a cell, that includes unwinding a chromatin segment within or proximal to a target region of a nucleic acid in a cell and generating a double stranded break (DSB) within the target region of the nucleic acid whereby to alter the target region. In certain embodiments, the step of unwinding the chromatin segment may include contacting the chromatin segment with an RNA-guided helicase. In certain embodiments, the step of unwinding the chromatin does not include recruiting an exogenous trans-acting factor to the chromatin segment. The RNA-guided helicase may be an RNA-guided nuclease, and the RNA-guided nuclease may be complexed to a dead guide RNA (dgRNA) including a first targeting domain sequence of 15 or fewer nucleotides in length. In certain embodiments, the dgRNA may include modifications at the 5' or 3' end, including, but not limited to, an anti-reverse cap analog (ARCA) at the 5' end of the RNA, a polyA tail at the 3' end of the RNA, or both. In certain embodiments, the RNA-guided helicase may be an enzymatically active RNA-guided nuclease or may be configured to lack nuclease activity. In certain embodiments, the targeting domain sequence of the dgRNA may be complementary to a sequence proximal to the target region. "Proximal to," in some embodiments herein, may mean within 10, 25, 50, 100, or 200 nucleotides of the target region. In certain embodiments, the step of unwinding the chromatin segment may not include forming a single or double-stranded break in the nucleic acid within the chromatin segment. In certain embodiments, the step of generating the DSB within the target region may include contacting the chromatin segment with an RNA-guided nuclease having nuclease activity. In certain embodiments, the RNA-guided nuclease having nuclease activity may be complexed to a gRNA including a targeting domain configured to overlap the target region. In certain embodiments, the RNA-guided nuclease having nuclease activity may be a Cpf1 molecule.

Another aspect of the disclosure includes a method of inducing accessibility to a target region of a nucleic acid for editing in a cell including contacting the cell with an RNA-guided helicase and a dgRNA and unwinding DNA within or proximal to the target region with the RNA-guided helicase thereby inducing accessibility to the target region for editing. In various cases, the RNA-guided helicase and the dgRNA may be configured to associate within or proximal to the target region. In certain embodiments, the dgRNA may be configured such that it does not provide an RNA-guided nuclease cleavage event. In certain embodiments, the RNA-guided helicase and dgRNA may complex to form a dead ribonucleoprotein (RNP) that lacks cleavage activity. In certain embodiments, the dgRNA may include a targeting domain sequence of 15 or fewer nucleotides in length. In certain embodiments, the RNA-guided helicase may be an RNA-guided nuclease. In certain embodiments, the RNA-guided nuclease and dgRNA are not configured to recruit an exogenous trans-acting factor to the target region. In certain embodiments, the RNA-guided nuclease may be a Cas9 or a Cas9-fusion protein. In certain embodiments, the Cas9 may be an enzymatically active Cas9 or an enzymatically dead Cas9. In certain embodiments, the Cas9 may be anickase, e.g., Cas9 D10A. In certain embodiments, the step of unwinding the DNA does not comprise forming a single or double-stranded break in the DNA. In certain embodiments, the RNA-guided nuclease having nuclease activity may be complexed to a gRNA including a targeting domain configured to overlap the target region. In certain embodiments, the RNA-guided nuclease having nuclease activity may be a Cpf1 molecule.

In another aspect, the disclosure relates to a method of increasing a rate of indel formation in a nucleic acid that includes unwinding double stranded DNA within or proximal to a target region of the nucleic acid using an RNA-guided helicase configured to associate within or proximal to the target region and generating a DSB within the target region. In certain embodiments, generating a DSB within the target region results in forming an indel at the target region. In certain embodiments, the DSB may be repaired in a manner forming an indel at the target region. In certain embodiments, the rate of indel formation in the gene achieved using the RNA-guided helicase is increased compared to a rate of indel formation in the gene achieved without using the RNA-guided helicase. In certain embodiments, the RNA-guided helicase may form an RNP complex with a dgRNA configured to associate within or proximal to the target region. In certain embodiments, the dgRNA may include a targeting domain sequence of 15 nucleotides or less in length. In certain embodiments, the RNA-guided helicase may be an RNA-guided nuclease. In certain embodiments, the RNA-guided nuclease may be a Cas9 or a Cas9-fusion protein. In certain embodiments, the Cas9 may be an enzymatically active Cas9 or an enzymatically dead Cas9. In certain embodiments, the Cas9 may be a nickase, e.g., Cas9 D10A. In certain embodiments, the RNA-guided nuclease and the dgRNA are not configured to recruit an exogenous trans-acting factor to the target region. In certain embodiments, the step of unwinding the double stranded DNA does not include forming a single or double-stranded break in the DNA.

In yet another aspect, this disclosure relates to a method of deleting a segment of a target nucleic acid in a cell that includes contacting the cell with an RNA-guided helicase and generating a DSB within the target region, whereby a segment of the target nucleic acid is deleted. In certain embodiments, the DSB may be repaired in a manner that deletes a segment of the target nucleic acid. In certain embodiments, the RNA-guided helicase may be configured to associate within or proximal to a target region of the target nucleic acid and unwind double stranded DNA (dsDNA) within or proximal to the target region. In certain embodiments, the RNA-guided helicase may form an ribonucleoprotein complex with a dgRNA configured to associate within or proximal to the target region. In certain embodiments, the dgRNA may include a targeting domain sequence of 15 nucleotides or less in length. In certain embodiments, the RNA-guided helicase may be an RNA-guided nuclease. In certain embodiments, the RNA-guided nuclease may be a Cas9 or a Cas9-fusion protein. In certain embodiments, the Cas9 may be an enzymatically active Cas9 or an enzymatically dead Cas9. In certain embodiments, the RNA-guided nuclease and the dgRNA are not configured to recruit an exogenous trans-acting factor to the target region. In certain embodiments, the target nucleic acid may be a promoter region of a gene, a coding region of a gene, a non-coding region of a gene, an intron of a gene, or an exon of a gene. In certain embodiments, the segment of the target nucleic acid may be at least about 15, 20, 25, 30, 35, 40, 45, 50, 55, 60, 65, 70, 75, or 100 base pairs in length.

The disclosure also relates to a dead gRNA (dgRNA) molecule including a targeting domain comprising a truncation of a gRNA targeting domain. In certain embodiments, the gRNA targeting domain to be truncated may be a gRNA targeting domain set forth in Table 2, Table 10, or Table 15. In certain embodiments, the gRNA targeting domain may be truncated from a 5' end of the gRNA targeting domain. In certain embodiments, the dgRNA may include a targeting domain sequence of 15 nucleotides or less in length. In certain embodiments, the first targeting domain may be the same as or may differ by no more than 3 nucleotides from a dgRNA targeting domain set forth in Table 10 or Table 15.

Another aspect of the disclosure relates to compositions including at least one polynucleotide encoding a plurality of gRNAs and an RNA-guided helicase, in which at least one gRNA may be a dgRNA configured such that it does not provide an RNA-guided nuclease cleavage event. In certain embodiments, the dgRNA may include a targeting domain sequence of 15 nucleotides or less in length. In certain embodiments, the RNA-guided helicase may be an RNA-guided nuclease. In certain embodiments, the RNA-guided nuclease may be a Cas9 or a Cas9-fusion protein. In certain embodiments, the Cas9 may be an enzymatically active Cas9 or an enzymatically dead Cas9. In certain embodiments, the Cas9 may be anickase, e.g., Cas9 D10A. In certain embodiments, the RNA-guided nuclease and the dgRNA are not configured to recruit an exogenous trans-acting factor to the target region. In certain embodiments, the compositions further include a second RNA-guided nuclease configured to provide a cleavage event. In certain embodiments, the compositions further include a second gRNA configured to provide a cleavage event.

In another aspect, the disclosure relates to genome editing systems that include an RNA-guided nuclease and an RNA-guided helicase configured to associate with a target nucleic acid proximal to a target region of the target nucleic acid and induce a conformational change in the target region thereby promoting accessibility to the target region for the RNA-guided nuclease to form a break in the target region. The disclosure also relates to genome editing systems that include a dgRNA including a targeting domain sequence of 15 nucleotides or less in length, a first RNA-guided nuclease, and an RNA-guided helicase. In certain embodiments, the genome editing system further includes a gRNA. In certain embodiments, the gRNA and the first RNA-guided nuclease may associate with a target region in a target nucleic acid. In certain embodiments, the first RNA-guided nuclease may be a Cpf1 molecule. In certain embodiments, the gRNA and the first RNA-guided nuclease may associate with a first PAM sequence in a target nucleic acid, wherein the first PAM sequence is facing outward. In certain embodiments, the RNA-guided helicase may be a second RNA-guided nuclease. In certain embodiments, the second RNA-guided nuclease and the dgRNA are not configured to recruit an exogenous trans-acting factor to the target region. In certain embodiments, the dgRNA and the second RNA-guided nuclease associate within or proximal to a target region in the target nucleic acid. In certain embodiments, the first RNA-guided nuclease and second RNA-guided nuclease may be complexed with the gRNA and dgRNAs, respectively, forming first and second ribonucleoprotein complexes.

In another aspect, the disclosure relates to a genome editing system that includes a dgRNA comprising a targeting domain sequence of 15 nucleotides or less in length, a first RNA-guided nuclease, and an RNA-guided helicase. In certain embodiments, the gRNA and the first RNA-guided nuclease may associate with a target region in a target nucleic acid. In certain embodiments, the first RNA-guided nuclease may be a Cpf1 molecule. In certain embodiments, the gRNA and the first RNA-guided nuclease may associate with a first protospacer adjacent motif (PAM) sequence in a target nucleic acid. In certain embodiments, the first PAM sequence may be facing outward. In certain embodiments, the RNA-guided helicase may be a second RNA-guided nuclease. In certain embodiments, the second RNA-guided nuclease and the dgRNA are not configured to recruit an exogenous trans-acting factor to the target region. In certain embodiments, the dgRNA and the second RNA-guided nuclease may associate within or proximal to a target region in the target nucleic acid. In certain embodiments, the first RNA-guided nuclease and second RNA-guided nuclease may be complexed with the gRNA and dgRNAs, respectively, forming first and second ribonucleoprotein complexes. In certain embodiments, the dgRNA and the second RNA-guided nuclease may associate with a second PAM sequence in a target nucleic acid, wherein the second PAM sequence may be facing outward.

In another aspect, the disclosure relates to a genome editing system that includes a dgRNA, a first gRNA comprising a second targeting domain sequence greater than 17 nucleotides in length, a first RNA-guided nuclease, and a second RNA-guided nuclease. In certain embodiments, the first RNA-guided nuclease and the dgRNA may be configured to associate within a first target region in a target nucleic acid. In certain embodiments, the second RNA-guided nuclease and the first gRNA may be configured to associate within a second target region and generate a double stranded break (DSB) in the target nucleic acid whereby to create an indel between the first target region and the second target region. In certain embodiments, the second RNA-guided nuclease may be a Cpf1 molecule. In certain embodiments, the dgRNA may comprise a first targeting domain sequence of 15 nucleotides or less in length. In certain embodiments, the dgRNA has reduced or no RNA-guided nuclease cleavage activity. In certain embodiments, the dgRNA may be configured such that it does not provide an RNA-guided nuclease cleavage event. In certain embodiments, the dgRNA and the first RNA-guided nuclease may associate with a first protospacer adjacent motif (PAM) sequence in the target nucleic acid. In certain embodiments, the first PAM sequence may be facing outward. In certain embodiments, the first gRNA and the second RNA-guided nuclease may associate with a second PAM sequence in the target nucleic acid. In certain embodiments, the second PAM sequence may be facing outward.

In another aspect, the disclosure relates to a method of altering a cell, including contacting the cell with a dgRNA, a first gRNA comprising a second targeting domain sequence greater than 17 nucleotides in length, a first RNA-guided nuclease, and a second RNA-guided nuclease. In certain embodiments, the first RNA-guided nuclease and the dgRNA may be configured to associate within a first target region in a target nucleic acid. In certain embodiments, the second RNA-guided nuclease and the first gRNA may associate within a second target region and generate a double stranded break (DSB) in the target nucleic acid whereby to create an indel between the first target region and the second target region. In certain embodiments, the second RNA-guided nuclease may be a Cpf1 molecule. In certain embodiments, the dgRNA may comprise a first targeting domain sequence of 15 nucleotides or less in length. In certain embodiments, the dgRNA has reduced or no RNA-guided nuclease cleavage activity. In certain embodiments, the dgRNA may be configured such that it does not provide an RNA-guided nuclease cleavage event. In certain embodiments, the dgRNA and the first RNA-guided nuclease may associate with a first protospacer adjacent motif (PAM) sequence in the target nucleic acid. In certain embodiments, the first PAM sequence may be facing outward. In certain embodiments, the first gRNA and the second RNA-guided nuclease may associate with a second PAM sequence in the target nucleic acid. In certain embodiments, the second PAM sequence may be facing outward.

The disclosure herein also relates to methods of altering a cells, including contacting a cell with any of the genome editing systems disclosed herein. In certain embodiments, the step of contacting the cell may comprise contacting the cell with a solution comprising first and second ribonucleoprotein complexes. In certain embodiments, the step of contacting the cell with the solution further comprises electroporating the cells, thereby introducing the first and second ribonucleoprotein complexes into the cell.

In another aspect, the disclosure relates to cells that are altered using the methods disclosed herein. Cells that include a productive indel which results in HbF expression are also disclosed herein. In certain embodiments the indel may be produced by contacting the cell with a dgRNA, a first gRNA including a second targeting domain sequence greater than 17 nucleotides in length, a first RNA-guided nuclease, and a second RNA-guided nuclease. In certain embodiments, the first RNA-guided nuclease and the dgRNA may be configured to associate within a first target region in a target nucleic acid. In certain embodiments, the second RNA-guided nuclease and the first gRNA may associate with a second target region and generate a double stranded break (DSB) in the target nucleic acid whereby to create an indel between the first target region and the second target region. In certain embodiments, the cells disclosed herein, may be capable of differentiating into an erythroblast, erythrocyte, or a precursor of an erythrocyte or erythroblast. In certain embodiments, the cell may be a CD34+ cell.

A genome editing system or method including any of all of the features described above may include a target nucleic acid comprising a human HBG1, HBG2 gene, or a combination thereof. In certain embodiments, the target region may be a CCAAT box target region of the human HBG1, HBG2 gene, or a combination thereof. In certain embodiments, the first targeting domain sequence may be complementary to a first sequence on a side of a CCAAT box target region of the human HBG1, HBG2 gene, or a combination thereof, in which the first sequence optionally overlaps the CCAAT box target region of the human HBG1, HBG2 gene, or a combination thereof. In certain embodiments, the second targeting domain sequence may be complementary to a second sequence on a side of a CCAAT box target region of the human HBG1, HBG2 gene, or a combination thereof, in which the second sequence optionally overlaps the CCAAT box target region of the human HBG1, HBG2 gene, or a combination thereof. In certain embodiments, the first targeting domain may comprise a truncation of a gRNA targeting domain. In certain embodiments, the gRNA targeting domain may include the gRNAs set forth in Table 2, Table 10, or Table 15, and the gRNA targeting domain has been truncated from a 5' end of the gRNA targeting domain. In certain embodiments, the first targeting domain may be the same as or differs by no more than 3 nucleotides from a dgRNA targeting domain set forth in Table 10 or Table 15. In certain embodiments, the second targeting domain differs by no more than 3 nucleotides from a gRNA targeting domain set forth in Table 2, Table 10, or Table 15. In certain embodiments, the indel may alter the CCAAT box target region indel. In certain embodiments, the indel may be a productive indel resulting in an increased level of fetal hemoglobin expression. In certain embodiments, the gRNA, dgRNA, or both may be in vitro synthesized or chemically synthesized.

In certain embodiments, a cell may include at least one modified allele of the HBG locus generated by any of the methods for altering a cell disclosed herein, in which the modified allele of the HBG locus comprises an alteration of the human HBG1 gene, HBG2, gene, or a combination thereof.

In certain embodiments, an isolated population of cells may be modified by any of the methods for altering a cells disclosed herein, wherein the population of cells may include a distribution of indels that may be different from an isolated population of cells or their progenies of the same cell type that have not been modified by the method.

In certain embodiments, a plurality of cells may be generated by any of the methods for altering a cells disclosed herein, in which at least 20%, 30%, 40%, 50%, 60%, 70%, 80%, or 90% of the cells may include an alteration of a sequence in the CCAAT box target region of the human HBG1 gene, HBG2 gene or a combination thereof.

In certain embodiments, the cells disclosed herein may be used for a medicament. In certain embodiments, the cells may be for use in the treatment of β-hemoglobinopathy. In certain embodiments, β-hemoglobinopathy may be selected from the group consisting of sickle cell disease and beta-thalassemia.

In one aspect, the disclosure relates to compositions including a plurality of cells generated by a method including a dgRNA disclosed above, in which at least 20%, 30%, 40%, 50%, 60%, 70%, 80% or 90% of the cells include an alteration of a sequence of a CCAAT box target region of the human HBG1 or HBG2 gene or a plurality of cells generated by the method disclosed above, wherein at least 20%, 30%, 40%, 50%, 60%, 70%, 80% or 90% of the cells include an alteration of a sequence of a CCAAT box target region of the human HBG1 or HBG2. In certain embodiments, at least a portion of the plurality of cells may be within an erythroid lineage. In certain embodiments, the plurality of cells may be characterized by an increased level of fetal hemoglobin expression relative to an unmodified plurality of cells. In certain embodiments, the level of fetal hemoglobin may be increased by at least 20%, 30%, 40%, 50%, 60%, 70%, 80% or 90%. In certain embodiments, the compositions may further include a pharmaceutically acceptable carrier.

In one aspect, the disclosure relates to a population of cells modified by a genome editing system including a dgRNA described above, wherein the population of cells comprise a higher percentage of a productive indel relative to a population of cells not modified by the genome editing system. The disclosure also relates to a population of cells modified by the genome editing system including a dgRNA described above, wherein a higher percentage of the population of cells are capable of differentiating into a population of cells of an erythroid lineage that express HbF relative to a population of cells not modified by the genome editing system. In certain embodiments, the higher percentage may be at least about 15%, at least about 20%, at least about 25%, at least about 30%, or at least about 40% higher. In certain embodiments, the cells may be hematopoietic stem cells. In certain embodiments, the cells may be capable of differentiating into an erythroblast, erythrocyte, or a precursor of an erythrocyte or erythroblast. In certain embodiments, the indel may be created by a repair mechanism other than microhomology-mediated end joining (MMEJ) repair.

The disclosure also relates to the use of any of the cells disclosed herein in the manufacture of a medicament for treating β-hemoglobinopathy in a subject.

In one aspect, the disclosure relates to a method of treating a β-hemoglobinopathy in a subject in need thereof, comprising administering to the subject the cells disclosed herein. In certain embodiments, a method of treating a β-hemoglobinopathy in a subject in need thereof, may include administering a population of modified hematopoietic cells to the subject, wherein one or more cells have been altered according to the methods of altering a cell disclosed herein.

In one aspect, the disclosure relates to a genome editing system, comprising: an RNA-guided nuclease; and a first guide RNA, in which the first guide RNA may comprise a first targeting domain that is complementary to a first sequence on a side of a CCAAT box target region of a human HBG1, HBG2 gene, or a combination thereof, in which the first sequence optionally overlaps the CCAAT box target region of the human HBG1, HBG2 gene, or a combination thereof. In certain embodiments, the genome editing system may further comprise a template nucleic acid encoding an alteration of the CCAAT box target region of a human HBG1, HBG2 gene, or a combination thereof. In certain embodiments, the template nucleic acid may be a single stranded oligodeoxynucleotide (ssODN) or a double stranded oligodeoxynucleotide (dsODN). In certain embodiments, the ssODN may comprise a 5' homology arm, a replacement sequence, and a 3' homology arm. In certain embodiments, the homology arms may be symmetrical in length. In certain embodiments, the homology arms may be asymmetrical in length. In certain embodiments, the ssODN may comprise one or more phosphorothioate modifications. In certain embodiments, the one or more phosphorothioate modifications may be at the 5' end, the 3' end or a combination thereof. In certain embodiments, the ssODN may be a positive or negative strand. In certain embodiments, the alteration may be a non-naturally occurring alteration. In certain embodiments, the alteration may comprise a deletion of the CCAAT box target region. In certain embodiments, the deletion may comprise a 18 nt deletion, a 11 nt deletion, a 4 nt deletion, a 1 nt deletion, or a combination thereof. In certain embodiments, the CCAAT box target region may comprise a 18 nt target region, a 11 nt target region, a 4 nt target region, a 1 nt target region, or a combination thereof. In certain embodiments, the 5' homology arm may be about 25 to about 200 or more nucleotides in length, e.g., at least 25, 50, 75, 100, 125, 150, 175, or 200 nucleotides in length; the replacement sequence may comprise 0 nucleotides in length; and the 3' homology arm may be about 25 to about 200 or more nucleotides in length, e.g., at least about 25, 50, 75, 100, 125, 150, 175, or 200 nucleotides in length. In certain embodiments, the 5' homology arm may comprise about 50 to 100 bp, e.g., 55 to 95, 60 to 90, 70 to 90, or 80 to 90 bp, homology 5' of the 18 nt target region and the 3' homology arm may comprise about 50 to 100 bp, e.g., 55 to 95, 60 to 90, 70 to 90, or 80 to 90 bp, homology 3' of the 18 nt target region. In certain embodiments, the ssODN may comprise, may consist essentially of, or may consist of SEQ ID NO:974 or SEQ ID NO:975. In certain embodiments, the 5' homology arm may comprise about 50 to 100 bp, e.g., 55 to 95, 60 to 90, 70 to 90, or 80 to 90 bp, homology 5' of the 11 nt target region and the 3' homology arm may comprise about 50 to 100 bp, e.g., 55 to 95, 60 to 90, 70 to 90, or 80 to 90 bp, homology 3' of the 11 nt target region. In certain embodiments, the ssODN may comprise, may consist essentially of, or may consist of SEQ ID NO:976 or SEQ ID NO:978. In certain embodiments, the 5' homology arm may comprise about 50 to 100 bp, e.g., 55 to 95, 60 to 90, 70 to 90, or 80 to 90 bp, homology 5' of the 4 nt target region and the 3' homology arm may comprise about 50 to 100 bp, e.g., 55 to 95, 60 to 90, 70 to 90, or 80 to 90 bp, homology 3' of the 4 nt target region. In certain embodiments, the ssODN may comprise, may consist essentially of, or may consist of a sequence selected from the group consisting of SEQ ID NO:984, SEQ ID NO:985, SEQ ID NO:986, SEQ ID NO:987, SEQ ID NO:988, SEQ ID NO:989, SEQ ID NO:990, SEQ ID NO:991, SEQ ID NO:992, SEQ ID NO:993, SEQ ID NO:994, and SEQ ID NO:995. In certain embodiments, the 5' homology arm may comprise about 50 to 100 bp, e.g., 55 to 95, 60 to 90, 70 to 90, or 80 to 90 bp, homology 5' of the 1 nt target region and the 3' homology arm may comprise about 50 to 100 bp, e.g., 55 to 95, 60 to 90, 70 to 90, or 80 to 90 bp, homology 3' of the 1 nt target region. In certain embodiments, the homology arms may be symmetrical in length. In certain embodiments, the ssODN may comprise, may consist essentially of, or may consist of SEQ ID NO:982 or SEQ ID NO:983. In certain embodiments, the alteration may be a naturally occurring alteration. In certain embodiments, the alteration may comprise a deletion or mutation of the CCAAT box target region. In certain embodiments, the CCAAT box target region may comprise a 13 nt target region, −117G>A target region, or a combination thereof. In certain embodiments, the alteration may comprise a 13 nt deletion at the 13 nt target region or a substitution from G to A at the −117G>A target region, or a combination thereof. In certain embodiments, the 5' homology arm may comprise about 50 to 100 bp, e.g., 55 to 95, 60 to 90, 70 to 90, or 80 to 90 bp, homology 5' of the 13 nt target region and the 3' homology arm may comprise about 50 to 100 bp, e.g., 55 to 95, 60 to 90, 70 to 90, or 80 to 90 bp, homology 3' of the 13 nt target region. In certain embodiments, the ssODN may comprise, may consist essentially of, or may consist of SEQ ID NO:977 or SEQ ID NO:979. In certain embodiments, the 5' homology arm may comprise about 50 to 100 bp, e.g., 55 to 95, 60 to 90, 70 to 90, or 80 to 90 bp, homology 5' of the 13 nt target region and the 3' homology arm may comprise about 50 to 100 bp, e.g., 55 to 95, 60 to 90, 70 to 90, or 80 to 90 bp, homology 3' of the 13 nt target region. In certain embodiments, the ssODN may comprise, may consist essentially of, or may consist of SEQ ID NO:980 or SEQ ID NO:981. In certain embodiments, the RNA-guided nuclease may be an S. pyogenes Cas9. In certain embodiments, the RNA-guided nuclease may be a Cpf1 variant as disclosed herein. In certain embodiments, the first targeting domain may differ by no more than 3 nucleotides from a targeting domain listed in Table 7, Table 18, Table 19 or a gRNA in Table 12, Table 19. In certain embodiments, the genome editing system may further comprise a second guide RNA, wherein the second guide RNA may comprise a second targeting domain that may be complementary to a second sequence on a side of a CCAAT box target region of a human HBG1, HBG2 gene, or a combination thereof, wherein the second sequence optionally overlaps the CCAAT box target region of the human HBG1, HBG2 gene, or a combination thereof. In certain embodiments, the RNA-guided nuclease may be a nickase, and optionally lacks RuvC activity. In certain embodiments, the genome editing system may comprise first and second RNA-guided nucleases. In certain embodiments, the first and second RNA-guided nucleases may be complexed with the first and second guide RNAs, respectively, forming first and second ribonucleoprotein complexes. In certain embodiments, the genome editing system may further comprise a third guide RNA; and optionally a fourth guide RNA, wherein the third and fourth guide RNAs may comprise third and fourth targeting domains complimentary to third and fourth sequences on opposite sides of positions of a GATA1 binding motif in BCL11A erythroid enhancer (BCL11Ae) of a human BCL11A gene, wherein one or both of the third and fourth sequences optionally overlaps the GATA1 binding motif in BCL11Ae of the human BCL11A gene. In certain embodiments, the genome editing system may further comprise a nucleic acid template encoding a deletion of the GATA1 binding motif in BCL11Ae. In certain embodiments, the RNA-guided nuclease may be an S. pyogenes Cas9. In certain embodiments, the RNA-guided nuclease may be a nickase, and optionally lacks RuvC activity. In certain embodiments, the third targeting domain may be complimentary to a sequence within 1000 nucleotides upstream of the GATA1 binding motif in BCL11Ae. In certain embodiments, the third targeting domain may be complimentary to a sequence within 100 nucleotides upstream of the GATA1 binding motif in BCL11Ae. In certain embodiments, one of the third and fourth targeting domains may be complimentary to a sequence within 100 nucleotides downstream of the GATA1 binding motif in BCL11Ae. In certain embodiments, the fourth targeting domain may be complimentary to a sequence within 50 nucleotides downstream of the GATA1 binding motif in BCL11Ae. In certain embodiments, at least one of the third and fourth targeting domains may differ by no more than 3 nucleotides from a targeting domain listed in Table 9. In certain embodiments, genome editing system may comprise first and second RNA-guided nucleases. In certain embodiments, the first and second RNA-guided nucleases may be complexed with the third and fourth guide RNAs, respectively, forming third and fourth ribonucleoprotein complexes.

In one aspect, the disclosure relates to a method of altering a cell comprising contacting a cell with a genome editing system. In certain embodiments, the step of contacting the cell with the genome editing system may comprise contacting the cell with a solution comprising first and second ribonucleoprotein complexes. In certain embodiments, the step of contacting the cell with the solution may further comprise electroporating the cells, thereby introducing the first and second ribonucleoprotein complexes into the cell. In certain embodiments, the method of altering a cell may further comprise contacting the cell with a genome editing system, wherein the step of contacting the cell with the genome editing system may comprise contacting the cell with a solution comprising first, second, third, and optionally, fourth ribonucleoprotein complexes. In certain embodiments, the step of contacting the cell with the solution may further comprise electroporating the cells, thereby introducing the first, second, third, and optionally, fourth ribonucleoprotein complexes into the cell. In certain embodiments, the cell may be capable of differentiating into an erythroblast, erythrocyte, or a precursor of an erythrocyte or erythroblast. In certain embodiments, the cell may be a CD34$^+$ cell.

In one aspect, the disclosure relates to a CRISPR-mediated method of altering a cell, comprising: introducing a first DNA single strand break (SSB) or double strand break (DSB) within a genome of the cell between positions c.-106 to -120 of a human HBG1 or HBG2 gene; and optionally introducing a second SSB or DSB within the genome of the cell between positions c.-106 to -120 of the human HBG1 or HBG2 gene, wherein the first and second SSBs or DSBs may be repaired by the cell in a manner that alters a CCAAT box target region of the human HBG1 or HBG2 gene. In certain embodiments, the first and second SSBs or DSBs may be repaired by the cell in a manner that results in the alteration of a CCAAT box target region of the human HBG1 or HBG2 gene. In certain embodiments, the CRISPR-mediated method may further comprise a template nucleic acid encoding the alteration of the CCAAT box target region of a human HBG1, HBG2 gene, or a combination thereof. In certain embodiments, the template nucleic acid may be a single stranded oligodeoxynucleotide (ssODN). In certain embodiments, the ssODN may comprise a 5' homology arm, a replacement sequence, and a 3' homology arm. In certain embodiments, the ssODNs may be a positive or negative strand. In certain embodiments, the alteration may be anon-naturally occurring alteration. In certain embodiments, the first and second SSBs or DSBs may be repaired by the cell in a manner that results in the formation of at least one of an indel, a deletion, or an insertion in the CCAAT box target region of the human HBG1 or HBG2 gene. In certain embodiments, the CCAAT box target region may comprise a 18 nt target region, a 11 nt target region, a 4 nt target region, a 1 nt target region, or a combination thereof. In certain embodiments, the 5' homology arm may be about 25 to about 200 nucleotides or more in length, e.g., at least about 25, 50, 75, 100, 125, 150, 175, or 200 nucleotides in length; the replacement sequence may comprise 0 nucleotides in length; and the 3' homology arm may be about 25 to about 200 nucleotides or more in length, e.g., at least about 25, 50, 75, 100, 125, 150, 175, or 200 nucleotides in length. In certain embodiments, the 5' homology arm may comprise about 50 to 100 bp, e.g., 55 to 95, 60 to 90, 70 to 90, or 80 to 90 bp, homology 5' of the 18 nt target region, the 11 nt target region, the 4 nt target region, or the 1 nt target region and the 3' homology arm may comprise about 50 to 100 bp, e.g., 55 to 95, 60 to 90, 70 to 90, or 80 to 90 bp, homology 3' of 18 nt target region, the 11 nt target region, the 4 nt target region, or the 1 nt target region. In certain embodiments, the ssODN may comprise, may consist essentially of, or may consist of a sequence selected from the group consisting of SEQ ID NO:974, SEQ ID NO:975, SEQ ID NO:976, SEQ ID NO:978, SEQ ID NO:984, SEQ ID NO:985, SEQ ID NO:986, SEQ ID NO:987, SEQ ID NO:988, SEQ ID NO:989, SEQ ID NO:990, SEQ ID NO:991, SEQ ID NO:992, SEQ ID NO:993, SEQ ID NO:994, SEQ ID NO:995, SEQ ID NO:982 and SEQ ID NO:983. In certain embodiments, the alteration may be anon-naturally occurring alteration. In certain embodiments, the first and second SSBs or DSBs may be repaired by the cell in a manner that results in the formation of at least one of an indel, a deletion, or an insertion in the CCAAT box target region of the human HBG1 or HBG2 gene. In certain embodiments, the CCAAT box target region may comprise a 13 nt target region, -117G>A target region, or a combination thereof. In certain embodiments, the alteration may comprise a 13 nt deletion at the 13 nt target region or a substitution from G to A at the -117G>A target region, or a combination thereof. In certain embodiments, the 5' homology arm may comprise about 50 to 100 bp, e.g., 55 to 95, 60 to 90, 70 to 90, or 80 to 90 bp, homology 5' of the 13 nt target region or the -117G>A target region and the 3' homology arm may comprise about 50 to 100 bp, e.g., 55 to 95, 60 to 90, 70 to 90, or 80 to 90 bp, homology 3' of the 13 nt target region or the -117G>A target region. In certain embodiments, the ssODN may comprise, may consist essentially of, or may consist of a sequence selected from the group consisting of SEQ ID NO:977 or SEQ ID NO:979. SEQ ID NO:980 or SEQ ID NO:981.

In one aspect, the disclosure relates to a composition that may comprise a plurality of cells generated by a method of altering a cell disclosed herein, wherein at least 20%, 30%, 40%, 50%, 60%, 70%, 80% or 90% of the cells may comprise an alteration of a sequence of a CCAAT box target region of the human HBG1 gene, HBG2 gene, or a combination thereof. In certain embodiments, the alteration may comprise a 18 nt deletion, a 11 nt deletion, a 4 nt deletion, a 1 nt deletion, a 13 nt deletion, a substitution from G to A at the -117, of the human HBG1 gene, HBG2 gene, or a combination thereof. In certain embodiments, at least a portion of the plurality of cells may be within an erythroid lineage. In certain embodiments, the plurality of cells may be characterized by an increased level of fetal hemoglobin expression relative to an unmodified plurality of cells. In certain embodiments, the level of fetal hemoglobin may be increased by at least 20%, 30%, 40%, 50%, 60%, 70%, 80% or 90%. In certain embodiments, the composition may further comprise a pharmaceutically acceptable carrier.

In one aspect, the disclosure relates to a cell comprising a synthetic genotype generated by a method of altering a cell disclosed herein, wherein the cell may comprise a 18 nt deletion, a 11 nt deletion, a 4 nt deletion, a 1 nt deletion, a 13 nt deletion, a substitution from G to A at the −117, of the human HBG1 gene, HBG2 gene, or a combination thereof.

In one aspect, the disclosure relates to a cell comprising at least one allele of the HBG locus generated by a method of altering a cell disclosed herein, wherein the cell may encode a 18 nt deletion, a 11 nt deletion, a 4 nt deletion, a 1 nt deletion, a 13 nt deletion, a substitution from G to A at the −117, of the human HBG1 gene, HBG2 gene, or a combination thereof.

In one aspect, the disclosure relates to an AAV vector that may comprise a template nucleic acid encoding a non-naturally occurring alteration of a CCAAT box target region of a human HBG1, HBG2 gene, or a combination thereof. In certain embodiments, the template nucleic acid may be a single stranded oligodeoxynucleotide (ssODN). In certain embodiments, the CCAAT box target region may comprise a 18 nt target region, a 11 nt target region, a 4 nt target region, a 1 nt target region, or a combination thereof. In certain embodiments, the ssODN may comprise a 5' homology arm, a replacement sequence, and a 3' homology arm. In certain embodiments, the 5' homology arm may be about 25 to about 200 or more nucleotides in length, e.g., at least about 25, 50, 75, 100, 125, 150, 175, or 200 nucleotides in length; the replacement sequence may comprise 0 nucleotides in length; and the 3' homology arm may be about 25 to about 200 or more nucleotides in length, e.g., at least about 25, 50, 75, 100, 125, 150, 175, or 200 nucleotides in length. In certain embodiments, the 5' homology arm may comprise about 50 to 100 bp, e.g., 55 to 95, 60 to 90, 70 to 90, or 80 to 90 bp, homology 5' of the 18 nt target region, the 11 nt target region, the 4 nt target region, or the 1 nt target region and the 3' homology arm may comprise about 50 to 100 bp, e.g., 55 to 95, 60 to 90, 70 to 90, or 80 to 90 bp, homology 3' of 18 nt target region, the 11 nt target region, the 4 nt target region, or the 1 nt target region. In certain embodiments, the ssODN may comprise, may consist essentially of, or may consist of a sequence selected from the group consisting of SEQ ID NO:974-976, SEQ ID NO:978, SEQ ID NO:982-995.

In one aspect, the disclosure relates to a nucleotide sequence comprising a template nucleic acid encoding a non-naturally occurring alteration of a CCAAT box target region of a human HBG1, HBG2 gene, or a combination thereof. In certain embodiments, the template nucleic acid may be a single stranded oligodeoxynucleotide (ssODN) or a double stranded oligodeoxynucleotide (dsODN) comprising the alteration. In certain embodiments, the CCAAT box target region may comprise a 18 nt target region, a 11 nt target region, a 4 nt target region, a 1 nt target region, or a combination thereof. In certain embodiments, the ssODN may comprise a 5' homology arm, a replacement sequence, and a 3' homology arm. In certain embodiments, the 5' homology arm may be about 25 to about 200 or more nucleotides in length, e.g., at least about 25, 50, 75, 100, 125, 150, 175, or 200 nucleotides in length; the replacement sequence may comprise 0 nucleotides in length; and the 3' homology arm may be about 25 to about 200 or more nucleotides in length, e.g., at least about 25, 50, 75, 100, 125, 150, 175, or 200 nucleotides in length. In certain embodiments, the 5' homology arm may comprise about 50 to 100 bp, e.g., 55 to 95, 60 to 90, 70 to 90, or 80 to 90 bp, homology 5' of the 18 nt target region, the 11 nt target region, the 4 nt target region, or the 1 nt target region and the 3' homology arm may comprise about 50 to 100 bp, e.g., 55 to 95, 60 to 90, 70 to 90, or 80 to 90 bp, homology 3' of 18 nt target region, the 11 nt target region, the 4 nt target region, or the 1 nt target region. In certain embodiments, the ssODN may comprise, may consist essentially of, or may consist of a sequence selected from the group consisting of SEQ ID NO:974-976, SEQ ID NO:978, SEQ ID NO:982-995.

In one aspect, the disclosure relates to a cell comprising a synthetic genotype, wherein the cell may comprise a 18 nt deletion, a 11 nt deletion, a 4 nt deletion, a 1 nt deletion, a 13 nt deletion, a substitution from G to A at the −117, of the human HBG1 gene, HBG2 gene, or a combination thereof.

In one aspect, the disclosure relates to a composition, comprising a population of cells generated by a method of altering a cell disclosed herein, wherein the cells comprise a higher frequency of an alteration of a sequence of a CCAAT box target region of the human HBG1 gene, HBG2 gene, or a combination thereof relative to an unmodified population of cells. In certain embodiments, the higher frequency is at least about 10%, 20%, 30%, 40%, 50%, 60%, 70%, 80% or 90% higher. In certain embodiments, the alteration comprises a 18 nt deletion, a 11 nt deletion, a 4 nt deletion, a 1 nt deletion, a 13 nt deletion, a substitution from G to A at the −117, of the human HBG1 gene, HBG2 gene, or a combination thereof. In certain embodiments, at least a portion of the population of cells are within an erythroid lineage.

This listing is intended to be exemplary and illustrative rather than comprehensive and limiting. Additional aspects and embodiments may be set out in, or apparent from, the remainder of this disclosure and the claims.

BRIEF DESCRIPTION OF THE DRAWINGS

The accompanying drawings are intended to provide illustrative, and schematic rather than comprehensive, examples of certain aspects and embodiments of the present disclosure. The drawings are not intended to be limiting or binding to any particular theory or model, and are not necessarily to scale. Without limiting the foregoing, nucleic acids and polypeptides may be depicted as linear sequences, or as schematic two- or three-dimensional structures; these depictions are intended to be illustrative rather than limiting or binding to any particular model or theory regarding their structure.

FIG. 1. Each gene in the β-globin gene cluster is transcriptionally regulated by a proximal promoter. While not wishing to be bound by any particular theory, it is generally thought that $A_\gamma$ and/or $G_\gamma$ expression is activated by engagement between the proximal promoter with the distal strong erythroid-specific enhancer, the locus control region (LCR). Long-range transactivation by the LCR is thought to be mediated by alteration of chromatin configuration/confirmation. The LCR is marked by 4 erythroid specific Dnase I hypersensitive sites (HS1-4) and 2 distal enhancer elements (5' HS and 3' HS1). □-like gene globin gene expression is regulated in a developmental stage-specific manner, and expression of globin genes changes coincide with changes in the main site of blood production.

FIG. 3A Gene editing as determined by T7E1 endonuclease assay analysis (referred to interchangeably as a "T7E1 analysis") of HBG1 and HBG2 locus-specific PCR products amplified from genomic DNA extracted from K562 cells after electroporation with DNA encoding S. pyogenes-specific gRNAs and plasmid DNA encoding S. pyogenes Cas9. FIG. 3B Gene editing as determined by DNA sequence analysis of PCR products amplified from the HBG1 locus in genomic DNA extracted from K562 cells after electroporation with DNA encoding the indicated gRNA and Cas9 plasmid. FIG. 3C Gene editing as determined by DNA sequence analysis of PCR products amplified from the HBG2 locus in genomic DNA extracted from K562 cells after electroporation with DNA encoding the indicated gRNA and Cas9 plasmid. For FIG. 3B-C, the types of editing events (insertions, deletions) and subtypes of deletions (13 nt target partially [12 nt HPFH] or fully [13-26nt HPFH] deleted, other sequences deleted [other deletions]) are indicated by the differently shaded/patterned bars.

FIG. 4A depicts the percentage of indels detected by T7E1 analysis of HBG1 and HBG2 specific PCR products amplified from gDNA extracted from CB CD34+ cells treated with the indicated RNPs or donor matched untreated control cells (n=3 CB CD34+ cells, 3 separate experiments). Data shown represent the mean and error bars correspond to standard deviation across the 3 separate donors/experiments. FIG. 4B depicts the percentage of indels detected by T7E1 analysis of HBG2 specific PCR product amplified from gDNA extracted from CB CD34+ cells or adult CD34+ cells treated with the indicated RNPs or donor matched untreated control cells (n=3 CB CD34+ cells, n=3 mobilized peripheral blood (mPB) CD34+ cells, 3 separate experiments). Data shown represent the mean and error bars correspond to standard deviation across the 3 separate donors/experiments. FIG. 4C (Top panel) depicts indels as detected by T7E1 analysis of HBG2 PCR products amplified from gDNA extracted from human CB CD34+ cells electroporated with HBG Sp35 RNP or HBG Sp37 RNP+/−ssODN (unmodified or with PhTx modified 5' and 3' ends). The lower left panel shows the level of gene editing as determined by Sanger DNA sequence analysis of gDNA from cells edited with HBG Sp37 RNP and ssODN. The lower right panel shows the specific types of deletions detected within total deletions.

FIG. 5A depicts the percentage of indels detected by T7E1 analysis of HBG2 PCR product amplified from gDNA extracted from mPB CD34+ cells treated with the RNP or donor matched untreated control cells. FIG. 5B depicts the fold change in HBG mRNA expression in day 7 erythroblasts that were differentiated from RNP treated and untreated donor matched control mPB CD34+ cells. mRNA levels are normalized to GAPDH and calibrated to the levels detected in untreated controls on the corresponding days of differentiation.

FIG. 6A shows hematopoietic myeloid/erythroid colony forming cell (CFC) potential, where the number and subtype of colonies are indicated (GEMM: granulocyte-erythroid-monocyte-macrophage colony, E: erythroid colony, GM: granulocyte-macrophage colony, M: macrophage colony, G: granulocyte colony). FIG. 6B depicts the percentage of Glycophorin A expressed over the time course of erythroid differentiation as determined by flow cytometry analysis at the indicated time points and for the indicated samples.

FIG. 10C depicts the % of HbF protein detected by HPLC analysis (% HbF=100%×HbF/(HbF+HbA). FIG. 10D depicts the hematopoietic activity of the RNP treated and donor matched untreated control CD34+ cells in colony forming cell (CFC) assays. CFCs shown are per thousand CD34+ cells plated. FIG. 10E depicts human blood CD45+ cell reconstitution of the peripheral blood in immunodeficient mice (NSG) 1 month after transplantation with donor matched human mPB CD34+ that were either untreated (0 µM), or treated with one of two doses (2.5 and 3.75 µM) of D10A RNP and paired gRNAs. FIG. 10F depicts human blood CD45+ cell reconstitution of the peripheral blood in immunodeficient mice (NSG)2 months after transplantation.

FIGS. 10G and 10H depict the lineage distributions following human CD45+ blood cell reconstitution of NSG mice at 1 month (FIG. 10G) and 2 months (FIG. 10H).

FIG. 14D depicts the acquisition of erythroid phenotype (Glycophorin A+ cells) in differentiated control and RNP-treated BM CD34+ cells, while

FIG. 15A depicts the percentage of indels detected by T7E1 analysis of HBG2 PCR product amplified from gDNA extracted from mPB CD34+ cells treated with the BCL11Ae RNP and nonspecific ssODN or donor matched untreated control cells. FIG. 15B depicts the fold change in HBG mRNA expression in day 10 erythroblasts that were differentiated from BCL11Ae RNP treated and untreated donor matched control mPB CD34+ cells (mRNA levels are normalized to GAPDH and calibrated to the levels detected in untreated controls on the corresponding days of differentiation). FIG. 15C depicts the percentage of Glycophorin A expressed over the time course of erythroid differentiation of mPB CD34+ cells+/−treatment with BCL11Ae RNP and nonspecific ssODN, as determined by flow cytometry analysis at the indicated time points and for the indicated samples.

FIG. 17A depicts AgammaT (AγT)-globin chain expression as determined by [AγT-globin chain]/[all-gamma chains+beta chain] for clones carrying the indicated indels on the corresponding HBG1 allele (HBG1 Δ-115, HBG1 Δ-114:-115, HBG1 Δ-113:-115, HBG1 Δ-112:-115, HBG1 Δ-102:-114, HBG1 Δ-104:-121, HBG1 Δ-116). FIG. 17B depicts G gamma (Gγ)-globin chain expression as determined by [Gγ-gamma chain]/[all-gamma chains+beta chain] for clones carrying the indicated indels on an HBG2 allele (HBG2 Δ-115, HBG2 Δ-114:-115, HBG2 Δ-113:-115, HBG2 Δ-112:-115, HBG2 Δ-102:-114, HBG2 Δ-104:-121, HBG2 Δ-116). To insure that the analysis of G gamma (Gγ)-globin induction is the result of a single edited allele, only clones with monoallelic editing of HBG2, or with a deletion of one of the HBG2 allele were analyzed (resulting from the 4.9 kb deletion). FIG. 17C depicts AG gammaT (AGγT)-globin chain expression as determined by [AGγT-gamma chain]/[all-gamma chains+beta chain] for clones carrying the indicated indels on the corresponding HBG1/2 allele (HBG1/2 Δ-115, HBG1/2 Δ-114:-115, HBG1/2 Δ-113:-115, HBG1/2 Δ-112:-115, HBG1/2 Δ-102:-114, HBG1/2 Δ-104:-121, HBG1/2 Δ-116). FIG. 17D depicts AGgammaI (AGγI)-globin chain expression as determined by [AGγI-gamma chain]/[all-gamma chains+beta chain] for clones carrying the indicated indels on the corresponding HBG1/2 allele (HBG1/2 Δ-115, HBG1/2 Δ-114:-115, HBG1/2 Δ-113:-115, HBG1/2 Δ-112:-115, HBG1/2 Δ-102:-114, HBG1/2 Δ-104:-121, HBG1/2 Δ-116).

FIG. 19A depicts the percentage of indels detected by sequencing the HBG PCR product 72 hours after electroporation with OLI8394-RNP and ssODN OLI16413 ("−41 nt+strand") or ssODN OLI16411 ("−41 nt− strand"). FIG. 19B depicts the percentage of the precise "−11 nt deletion" to the total indels detected by sequencing the HBG PCR product 72 hours after electroporation with OLI8394-RNP and ssODN OLI16413 ("−11 nt+strand") or ssODN OLI16411 ("−41 nt− strand"). FIG. 19C depicts the percentage of indels detected by sequencing the HBG PCR product 72 hours after electroporation with OLI8394-RNP and ssODN OLI16430 ("−4 nt+strand") or ssODN OLI16424 ("−4 nt− strand"). The percentage of the precise −4 nt deletion (i.e., A-112:-115) is distinguished from other indels. FIG. 19D depicts the percentage of indels detected by sequencing the HBG PCR product 72 hours after electroporation with OLI8394-RNP and ssODN OLI16418 ("−1 nt+strand") or ssODN OLI16417 ("−1 nt− strand"). The percentage of the precise −1 nt deletion (i.e., A-116) is distinguished from other indels. FIG. 19E depicts the percentage of indels detected by sequencing the HBG PCR product 72 hours after electroporation with OLI8394-RNP and ssODN OLI16409 ("−18 nt+strand") or ssODN OLI16410 ("−18 nt− strand"). The percentage of the precise −18 nt deletion (i.e., A-104:-121) is distinguished from other indels. FIG. 19F depicts the percentage of indels detected by sequencing the HBG PCR product 72 hours after electroporation with OLI7066-RNP and ssODN OLI16414 ("−13 nt+strand") or ssODN OLI16412 ("−13 nt− strand"). The percentage of the precise −13 nt deletion (i.e., Δ-102:-114) is distinguished from other indels FIG. 19G depicts the percentage of indels detected by sequencing the HBG PCR product 72 hours after electroporation with OLI8394-RNP and ssODN OLI16416 ("−117 G>A+strand") or ssODN OLI16415 ("−117 G>A− strand"). The percentage of reads with the −117 G>A substitution, with or without indels are distinguished from other reads.

FIG. 20A depicts the percentage of gamma-globin chains over total beta-like globin chains (gamma chains/[gamma chains+beta chain]) as measured by UPLC after electroporation with (i) OLI8394-RNP and OLI7066-RNP alone, (ii) OLI8394-RNP and ssODN OLI16430 ("−4 nt+strand"), ssODN OLI16424 ("−4 nt− strand"), ssODN OLI16413 ("−11 nt+strand"), or ssODN OLI16411 ("−11 nt−strand"), and (iii) OLI7066-RNP and ssODN OLI16414 ("−13 nt+strand") or ssODN OLI16412 ("−13 nt− strand"). FIG. 20B depicts the percentage of gamma-globin chains over total beta-like globin chains (gamma chains/[gamma chains+beta chain]) as measured by UPLC after electroporation with OLI8394-RNP and ssODN OLI16418 ("−1 nt+strand"), ssODN OLI16417 ("−1 nt− strand"), ssODN OLI16416 ("−117 G>A+strand"), ssODN OLI16415 ("−117 G>A− strand"), ssODN OLI16409 ("−18 nt+strand"), or ssODN OLI16410 ("−18 nt− strand").

FIG. 21A depicts the percentage of indels detected by sequencing the HBG PCR product 72 hours after electroporation. FIG. 21B depicts frequency of 4.9 kb deletions detected by ddPCR between HBG1 and HBG2 after electroporation. FIG. 21C depicts the percentage viability of adult human CD34+ cells from mPB 48 hours after electroporation. FIG. 21D depicts the percentage of gamma-globin chains over total beta-like globin chains (gamma chains/[gamma chains+beta chain]) as measured by UPLC analysis of the cell lysates from the erythroid progeny of electroporated cells.

FIG. 22A depicts the percentage of indels detected by sequencing the HBG PCR product 72 hours after electroporation with indicated doses (2, 4, or 8 μM) of OLI8394-RNP and indicated doses (0, 1.25, 2.5, or 5 μM) of ssODN OLI16424 ("−4 nt− strand"). FIG. 22B depicts the percentage of −4 nt deletions ("−112:-115 deletions") detected by next generation sequencing (NGS) of the HBG PCR product after electroporation with indicated doses (2, 4, or 8 μM) of OLI8394-RNP and indicated doses (0, 1.25, 2.5, or 5 μM) of ssODN OLI16424 ("−4 nt− strand"). FIG. 22C depicts frequency of 4.9 kb deletions between HBG1 and HBG2 after electroporation with the indicated doses (2, 4, or 8 μM) of OLI8394-RNP and indicated doses (0, 1.25, 2.5, or 5 μM) of ssODN OLI16424 ("−4 nt− strand"). Deletions were measured via ddPCR. FIG. 22D depicts the percentage of gamma-globin chains over total beta-like globin chains (gamma chains/[gamma chains+beta chain]) as measured by UPLC analysis of the cell lysates from the erythroid progeny of mPB CD34+ cells after electroporation with the indicated doses (2, 4, or 8 μM) of OLI8394-RNP and indicated doses (0, 1.25, 2.5, or 5 μM) of ssODN OLI16424 ("−4 nt− strand").

FIG. 23A depicts the CCAAT box target sites at HBG1 and HBG2 that is targeted by OLI8394 (SEQ ID NO:971) and OLI7066 (SEQ ID NO:970). ssODNs with symmetrical or asymmetrical homology arms were designed to provide a template that copies the −4nt deletion (HBG-112:-115) of HBG1 and HBG2 (Table 11). The ssODN "encodes" the respective deletion with sequence homology arms flanking the absent sequence to create a perfect deletion at HBG-112:-115. FIG. 23B depicts the percentage of indels detected by sequencing the HBG PCR product 72 hours after electroporation of mPB CD34+ cells with 2 μM of OLI8394-RNP and 2.5 μM of various ssODNs, OLI16424 ("90/90"), OLI16419 ("40/80") or OLI16421 ("50/50"), that "encode" the 4 nt deletion (HBG-112:-115) (Table 11).

("His-AsCpf1-nNLS_HBG1-1 RNP" and "His-AsCpf1-sNLS-sNLS_HBG1-1 RNP"). The RNP were electroporated at 5 µM or 20 µM.

Figure 26A:
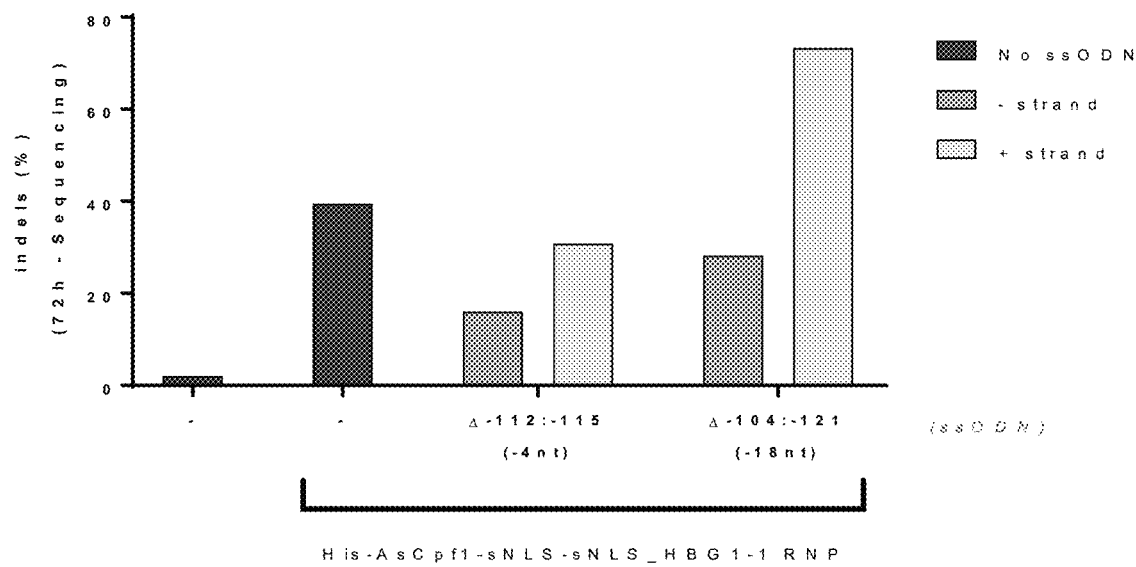
Figure 26B:
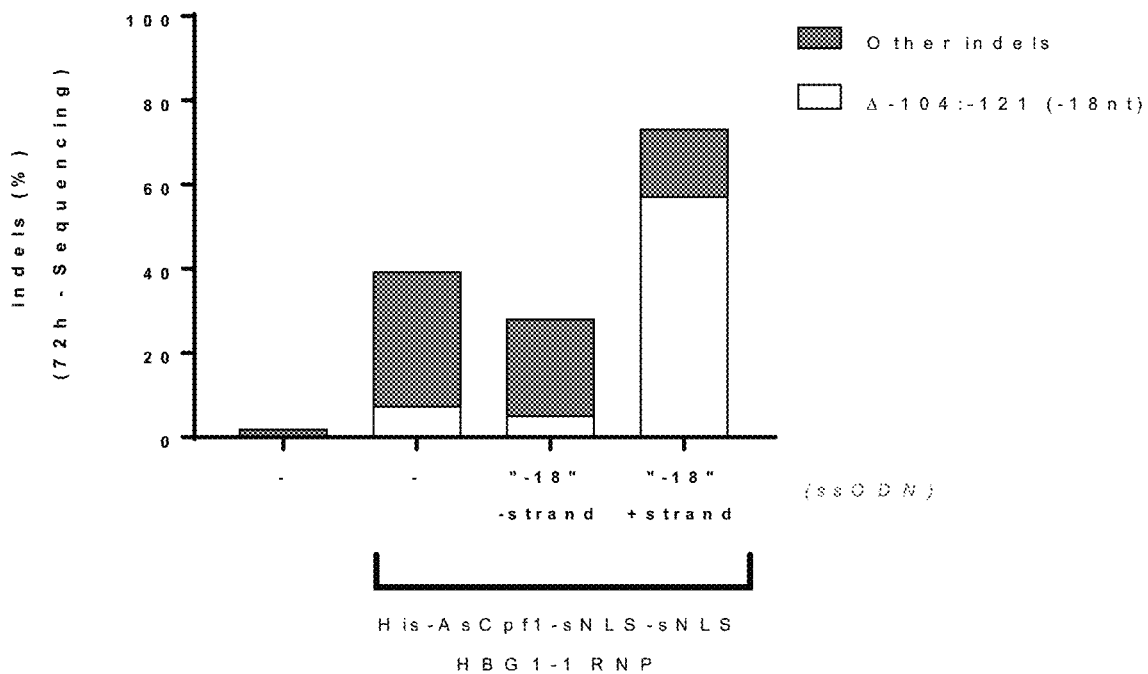

FIGS. 26A-C depict gene editing of HBG of mPB CD34+ cells electroporated with His-AsCpf1-sNLS-sNLS_HBG1-1 RNP alone or with various ssODNs. FIG. 26A depicts the percentage of indels detected by sequencing the HBG PCR product 72 hours after electroporation with His-AsCpf1-sNLS-sNLS_HBG1-1 RNP alone or with OLI164324 ("-4nt- strand"), OLI16430 ("-4 nt+strand"), OLI16410 ("-18 nt- strand"), or OLI16409 ("-18 nt+strand"). FIG. 26B depicts the percentage of the precise 18 nucleotide deletion indels detected by sequencing the HBG PCR product 72 hours after electroporation with His-AsCpf1-sNLS-sNLS_HBG1-1 RNP alone or with OLI16410 ("-18 nt- strand") or OLI16409 ("-18 nt+strand"). FIG. 26C depicts the percentage of the precise 18 nt deletion within all indels detected by sequencing the HBG PCR product 72 hours after electroporation with His-AsCpf1-sNLS-sNLS_HBG1-1 RNP alone or with OLI16410 ("-18 nt- strand") or OLI16409 ("-18 nt+strand").

Figure 27:
Figure 27:
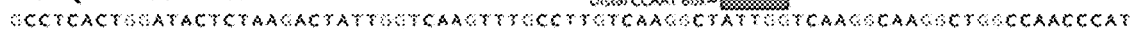
Figure 27:
Figure 27:
Figure 27:
Figure 27:

FIGS. 27A-F depict schematics of the HBG1-1 target region and S. pyogenes Cas9 gRNA pairs used in combination. FIG. 27A shows the target region of HBG1-1 gRNA (comprising the RNA targeting domain set forth in SEQ ID NO:1002, Table 15). The distal CCAAT box of HBG promoter (i.e., HBG1/2 c.-111 to -115) is indicated by a grey box. FIG. 27B shows the target region of HBG1-1, the distal CCAAT box of HBG, and the target region SpA gRNA (comprising the targeting domain of SEQ ID NO:941, Table 15). FIG. 27C shows the target region of HBG1-1, the distal CCAAT box of HBG, and the target region SpG gRNA (comprising the targeting domain of SEQ ID NO:359, Table 15). FIG. 27D shows the target region of HBG1-1, the distal CCAAT box of HBG, the target region of tSpA dead gRNA ("dgRNA") (comprising the targeting domain of SEQ ID NO:326, Table 15), and the target region of Sp182 dgRNA (comprising the targeting domain of SEQ ID NO:1028, Table 15). FIG. 27E shows the target region of HBG1-1, the distal CCAAT box of HBG, and tSpA dgRNA (comprising the targeting domain of SEQ ID NO:326, Table 15). FIG. 27F shows the target region of HBG1-1, the distal CCAAT box of HBG, and the target region of Sp182 dgRNA (comprising the targeting domain of SEQ ID NO:1028, Table 15).

Figure 28A:
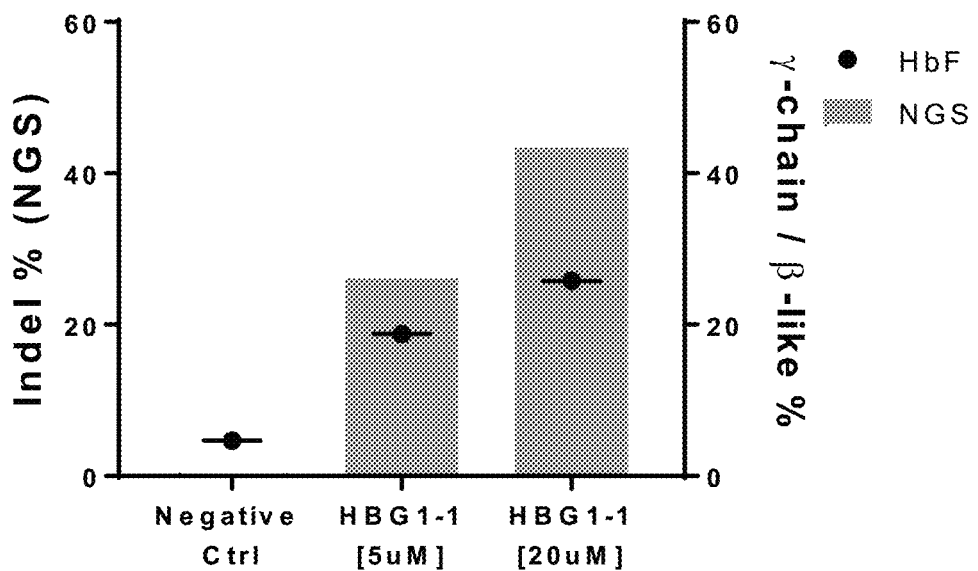
Figure 28B:
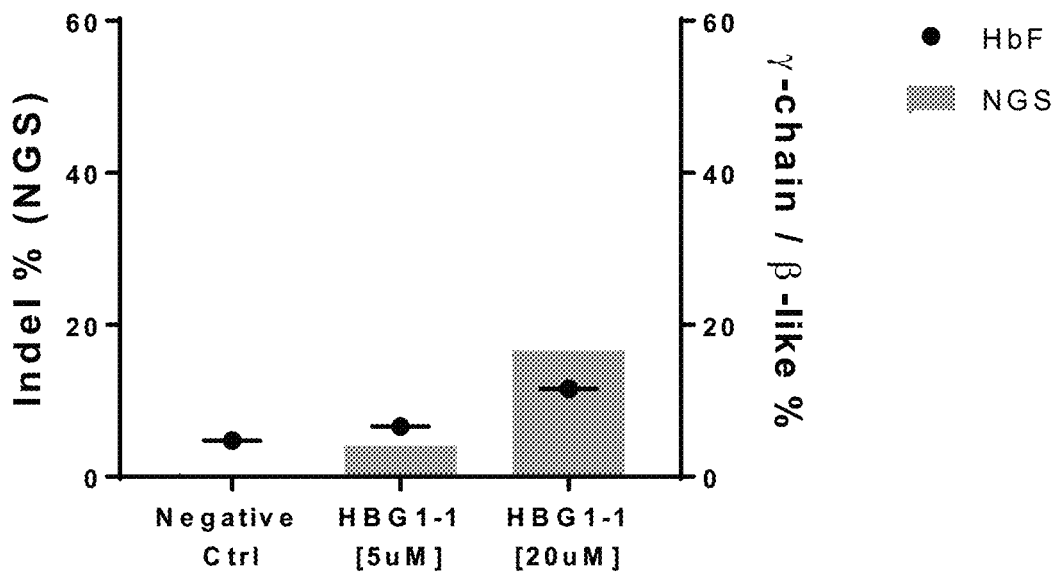

FIGS. 28A-B depict HbF expression achieved by ex vivo editing of mPB CD34+ cells using HBG1-1-AsCpf1-RNP targeting the HBG promoter region. FIG. 28A shows results of editing at the HBG promoter region following delivery of 5 µM or 20 µM HBG1-1-AsCpf1-RNP ("HBG-1-1") via Amaxa electroporation in mPB CD34+ cells. Delivery of 20 µM HBG1-1-AsCpf1-RNP via Amaxa electroporation results in up to ~43% editing, and 21% HbF induction (above background levels). HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Grey bars depict the percentage of indels 72 hours post-electroporation detected by next generation sequencing (NGS) of the HBG PCR product. FIG. 28B shows results of editing at the HBG promoter region following delivery of 5 µM or 20 µM HBG1-1-AsCpf1-RNP ("HBG-1-1") via MaxCyte electroporation in mPB CD34+ cells. Delivery of 20 µM HBG1-1-AsCpf1-RNP via MaxCyte electroporation results in up to ~16% editing, and 7% HbF induction (above background levels). HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Grey bars depict the percentage of indels 72 hours post-electroporation detected by NGS of the HBG PCR product.

Figure 29:
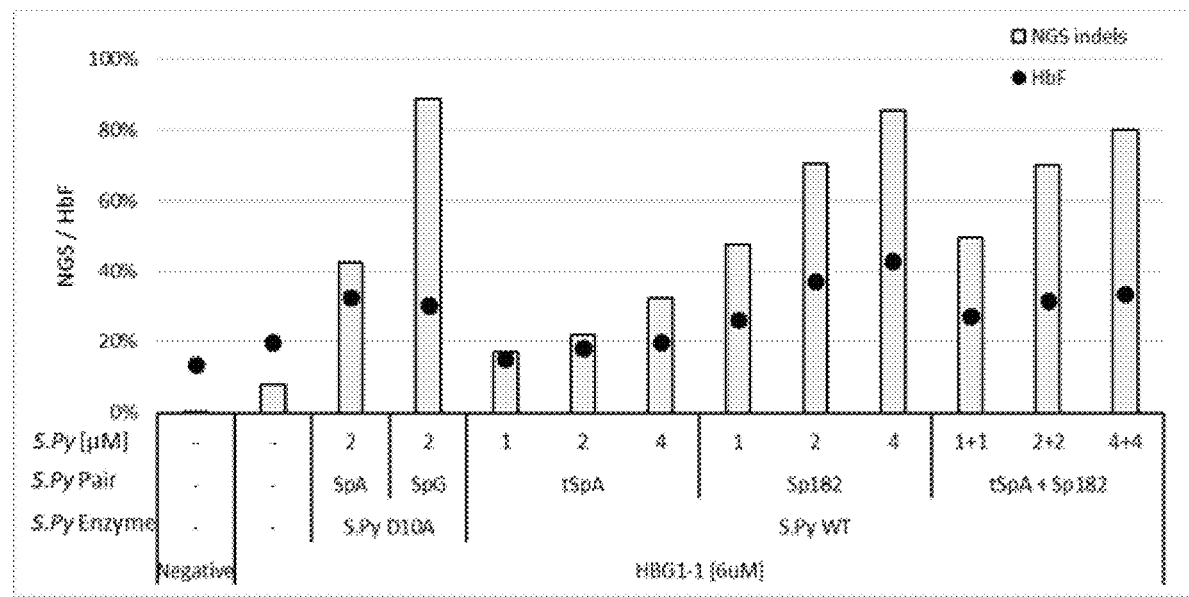

FIG. 29 depicts enhanced editing by HBG1-1-AsCpf1H800A-RNP at the HBG promotor region on the Maxcyte device by co-delivering various S. pyogenes Cas9 WT or Cas9D10A RNPs. "S.Py D10A" represents the Cas9 D10A nickase protein and "S.Py WT" represents the Cas9 WT protein. RNPs tested include SpA-D10A-RNP, SpG-D10A-RNP, tSpA-Cas9-RNP, Sp182-Cas9-RNP, and tSpA-Cas9-RNP+Sp182-Cas9-RNP (Table 14). Total editing at the HBG promoter region (grey bars) and the associated HbF protein induction (black circles) following delivery of HBG1-1-AsCpf1H800A-RNP alone ("HBG1-1"), or in combination with S. pyogenes Cas9 RNPs or pairs of RNP, is depicted. HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Grey bars depict the percentage of indels detected by NGS of the HBG PCR product.

Figure 30:
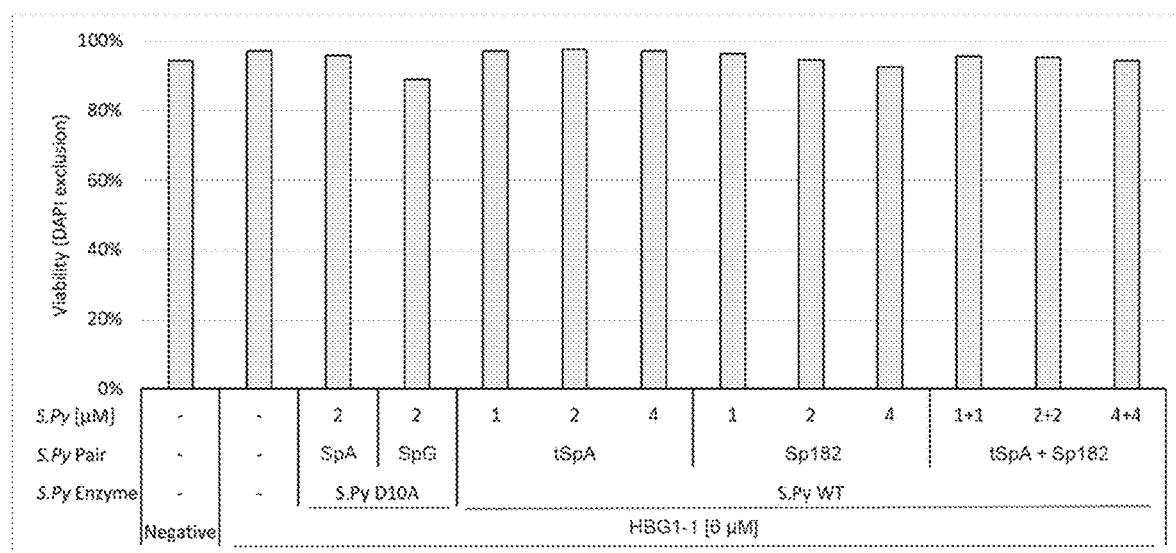

FIG. 30 depicts viability of mPB CD34+ cells following MaxCyte delivery of HBG1-1-AsCpf1H800A-RNP alone ("HBG1-1") or in combination with various S. pyogenes Cas9 WT or Cas9D10A RNPs. "S.Py D10A" represents the Cas9 D10A nickase protein and "S.Py WT" represents the Cas9 WT protein. RNPs tested include SpA-D10A-RNP, SpG-D10A-RNP, tSpA-Cas9-RNP, Sp182-Cas9-RNP, and tSpA-Cas9-RNP+Sp182-Cas9-RNP (Table 14). Viability was measured by DAPI staining and flow cytometry analysis at 24 h post electroporation.

Figure 31A:
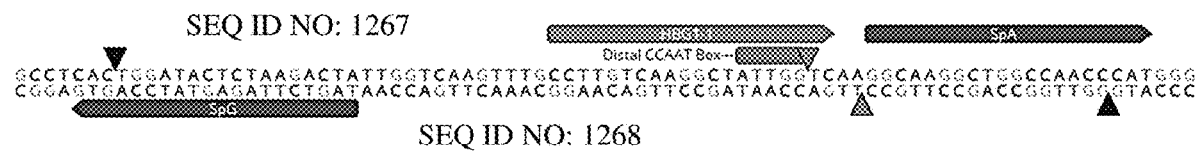
Figure 31B:
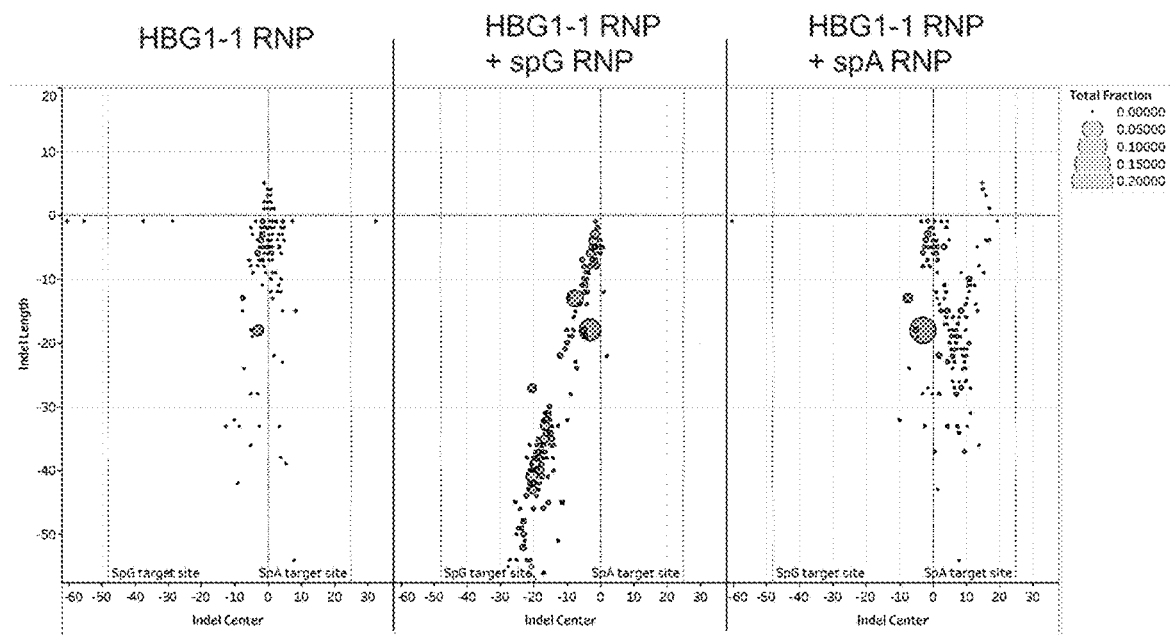

FIGS. 31A-B depict the cleavage sites of HBG1-1-AsCpf1H800A-RNP and D10A-Cas9 RNP at the target region and the editing profile resulting from the co-delivery of the HBG1-1-AsCpf1H800A-RNP with a D10A RNP. FIG. 31A depicts the position of the HBG1-1-AsCpf1H800A-RNP cut sites on each strand of the target region (light grey arrows), as well as position of the nicking site targeted by the SpG-D10A-RNP and SpA-D10A-RNP (dark arrows) (Table 14). FIG. 31B depicts the editing profile resulting from the co-delivery of the HBG1-1-AsCpf1H800A-RNP ("HBG1-1 RNP") with either SpG-D10A-RNP ("spG RNP") or SpA-D10A-RNP ("spA RNP") in mPB CD34+at 72 h post-electroporation as detected by NGS analysis of the HBG PCR product (Table 14). The X-axis represents genomic position of the center of the indel relative to the HBG1-1-AsCpf1H800A-RNP positive strand cleavage site. The Y axis represents the length of the indel, where deletions are represented as negative values and insertions are represented as positive values. The total frequency of each indel is represented by the area of the symbol. Indels occurring at frequency equal or above 0.10% are depicted. The SpG and SpA target sites are indicated by dotted lines.

Figure 32A:
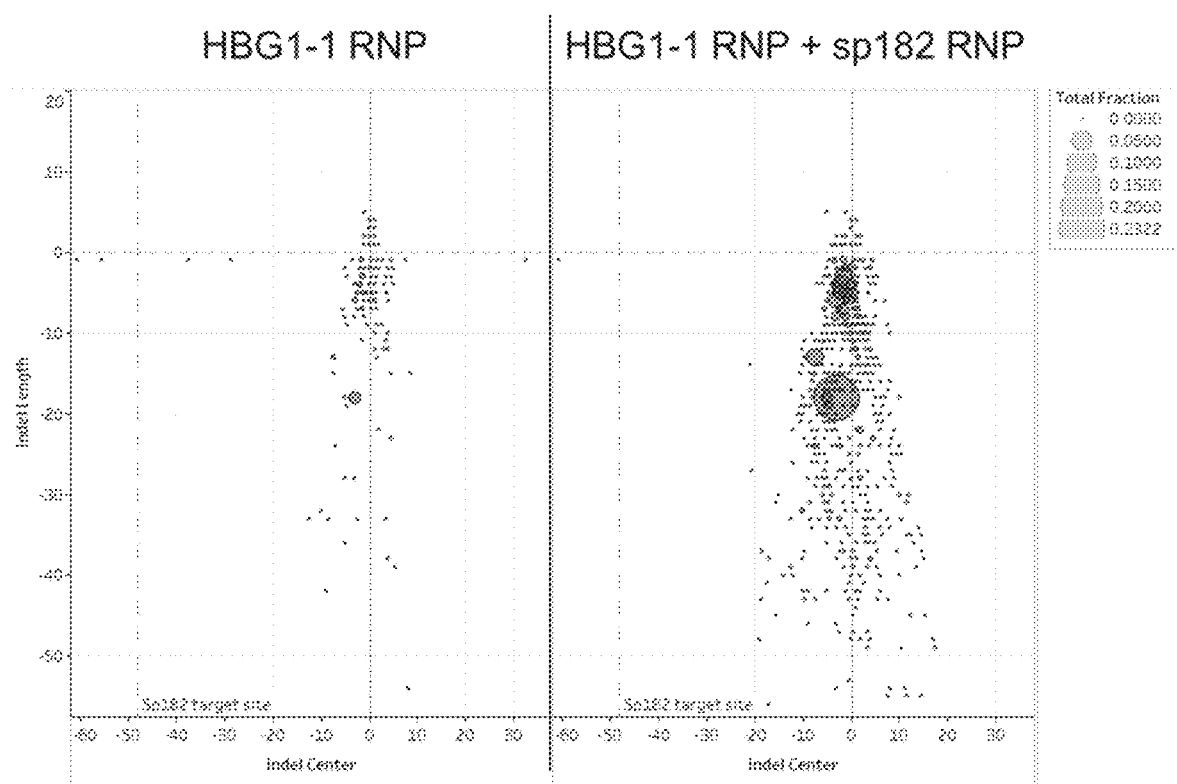
Figure 32B:
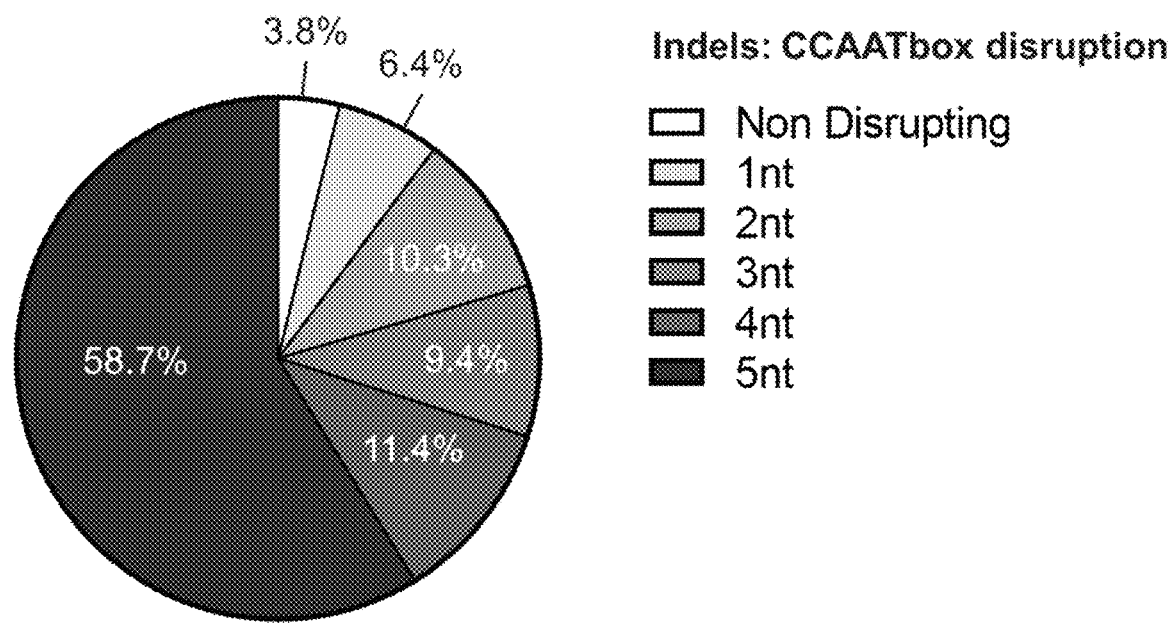

FIGS. 32A-B depict that the co-delivery of Sp182-Cas9-RNP with HBG1-1-AsCpf1H800A-RNP results in a boost in total indels and in distal CCAAT box disrupting indels with no substantial alteration of the indel profile, as detected by NGS analysis of the HBG PCR product at 72 h post-electroporation. FIG. 32A shows the indel profiles following editing with HBG1-1-AsCpf1H800A-RNP ("HBG1-1 RNP") alone, or in combination with Sp182-Cas9-RNP ("sp182 RNP"). The X-axis represents genomic position of the center of the indel relative to the HBG1-1-AsCpf1H800A-RNP positive strand cleavage site. The Y axis represents the length of the indel, where deletions are represented as negative values and insertions are represented as positive values. The total frequency of each indel is represented by the area of the symbol. Indels occurring at frequency equal or above 0.1% are depicted. The Sp182 target site is indicated by a dotted line. FIG. 32B depicts the frequency of indels disrupting either none, int, 2nt, 3nt, 4nt, or the entire 5nt of the distal CCAAT box sequence.

Figure 33:
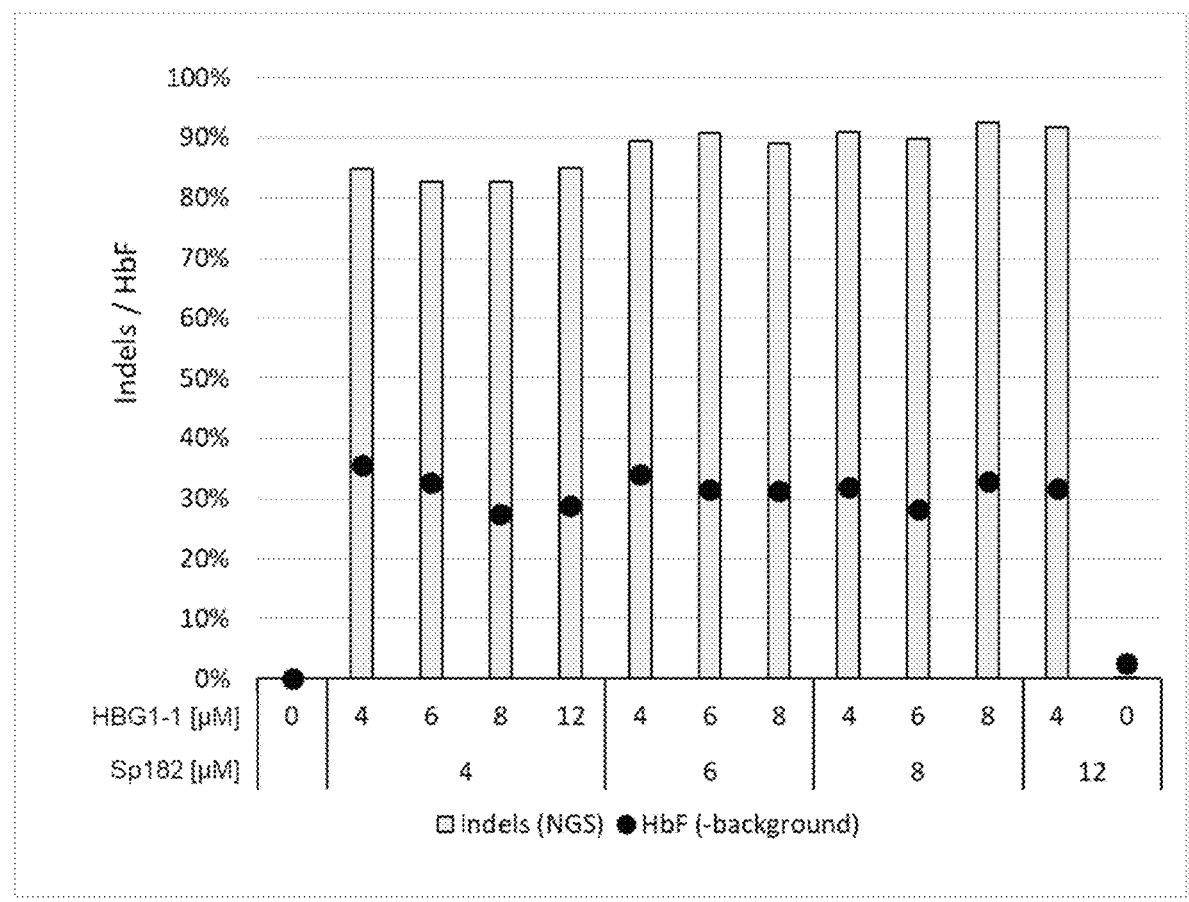

FIG. 33 depicts that optimal doses of HBG1-1-AsCpf1H800A-RNP co-delivered with Sp182-Cas9-RNP result in an increase in total editing, and HbF production (Table 14). Delivery of HBG1-1-AsCpf1H800A-RNP ("HBG1-1") as an RNP pair alongside Sp182-Cas9-RNP ("Sp182"), achieved >92% editing (grey bars) at the HBG promoter region with up to 34% HbF induction (above background) (black circles). No editing was observed when Sp182-Cas9-RNP was delivered alone at 12 µM. HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Grey bars depict the percentage of indels detected by NGS of the HBG PCR product.

Figure 34:
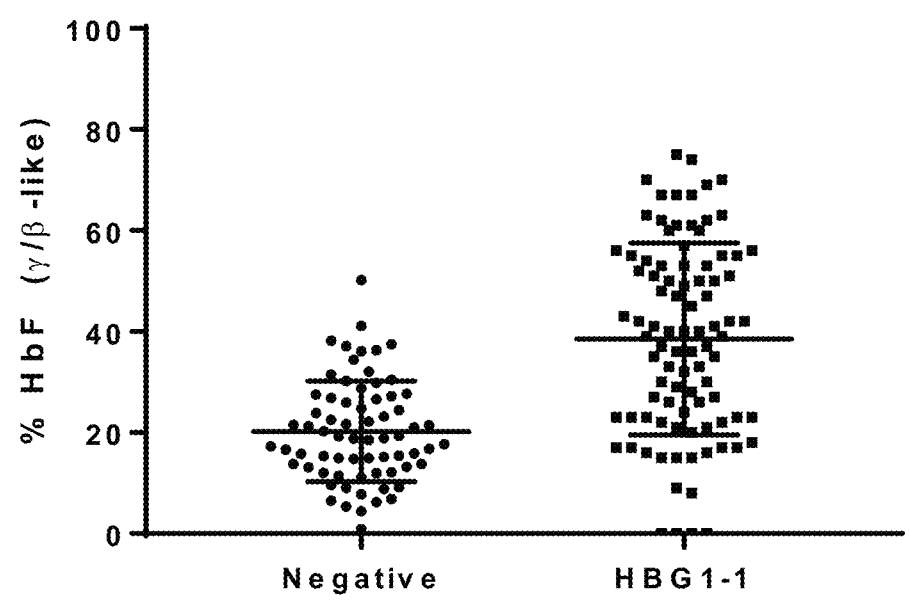

FIG. 34 depicts the distribution of levels of gamma chain expression over total beta-like chains (gamma chains/[gamma chains+beta chain]) as measured by UPLC in the clonal erythroid progeny of single human mPB CD34+ cells edited at the HBG promotor region with HBG1-1-AsCpf1H800A-RNP in combination with Sp182-Cas9-RNP (Table 14). Each black circle represents the gamma-globin protein level detected in a clonal erythroid population derived from a single cell, isolated by FACS sorting at 48 h post electroporation.

Figure 35A:
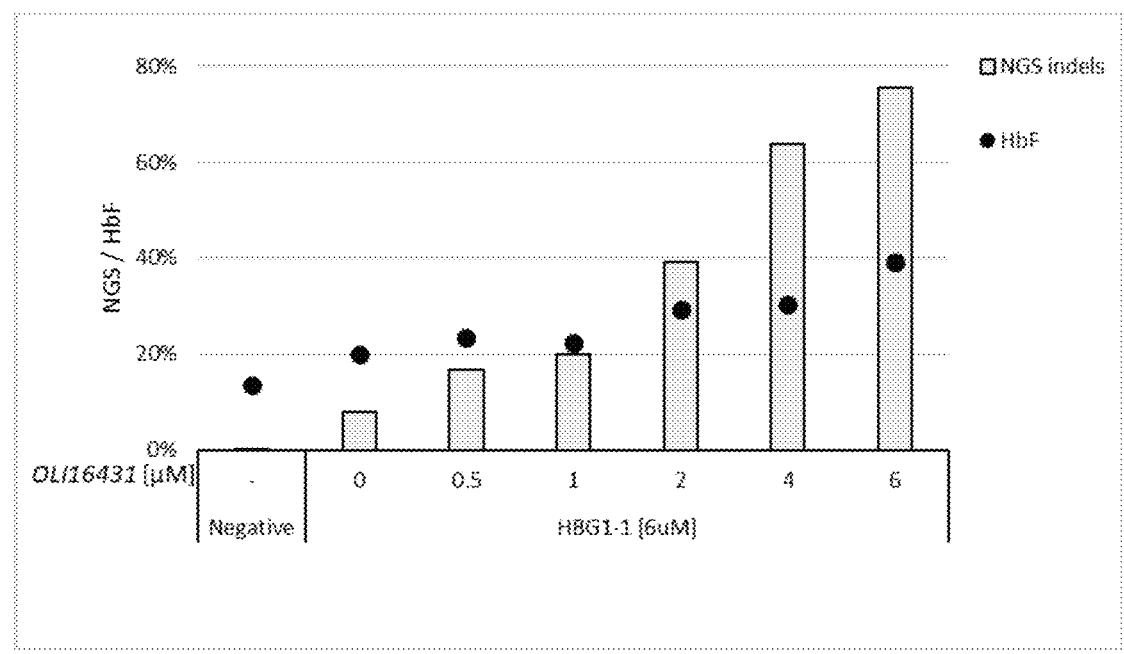
Figure 35B:
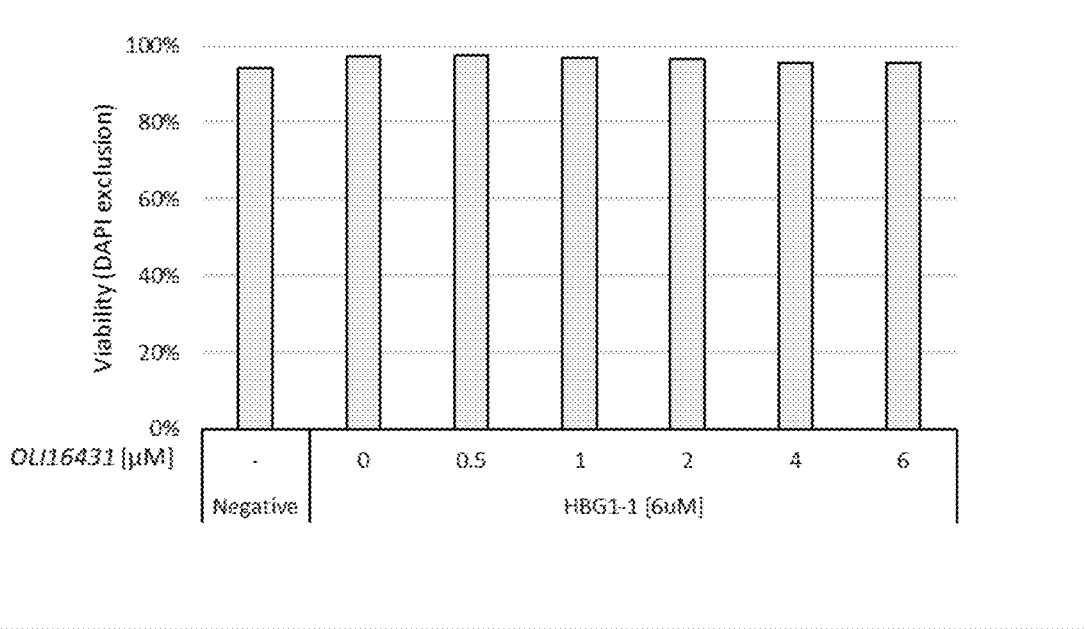

FIGS. 35A-C depicts total editing, HbF production, viability, and colony forming potential after co-delivery of RNP containing modified HBG1-1 gRNA (SEQ ID NO:1041, Table 14) complexed to His-AsCpf1-sNLS-sNLS H800A (SEQ ID NO:1032, Table 14) ("His-AsCpf1-sNLS-sNLS H800A_HBG1-1 RNP," represented as "HBG1-1" in FIGS. 35A-C) with increasing concentrations of ssODN OLI16431 (SEQ ID NO: 1040, Table 11) (represented as "OLI16431" in FIGS. 35A-C) (Table 11). FIG. 35A depicts editing at the distal CAATT box (grey bars) and HbF induction (black circles) after co-delivery of 6 µM His-AsCpf1-sNLS-sNLS H800A_HBG1-1 RNP and increasing concentrations of ssODN OLI16431. HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Grey bars depict the percentage of indels detected by NGS of the HBG PCR product. FIG. 35B depicts viability of mPB CD34+ cells following delivery of His-AsCpf1-sNLS-sNLS H800A_HBG1-1 RNP alone or in combination with increasing doses of ssODN OLI16431. Viability was measured by DAPI exclusion at 72 hours post electroporation. FIG. 35C depicts the hematopoietic activity of the "HBG1-1" RNP and ssODN OLI16431 treated and donor matched untreated control CD34+ cells in colony forming cell (CFC) assays. CFCs shown are per 800 CD34+ cells plated. The number and subtype of colonies are indicated (GEMM: granulocyte-erythroid-monocyte-macrophage colony (black), GM: granulocyte-macrophage colony (dark grey), E: erythroid colony (light grey)).

Figure 36A:
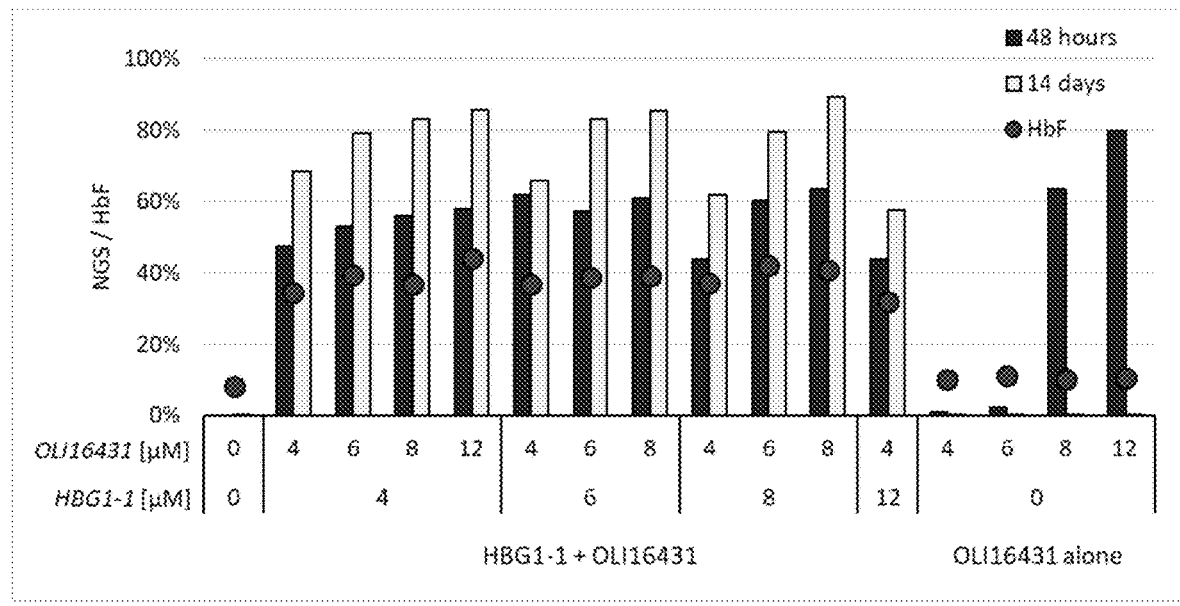
Figure 36B:
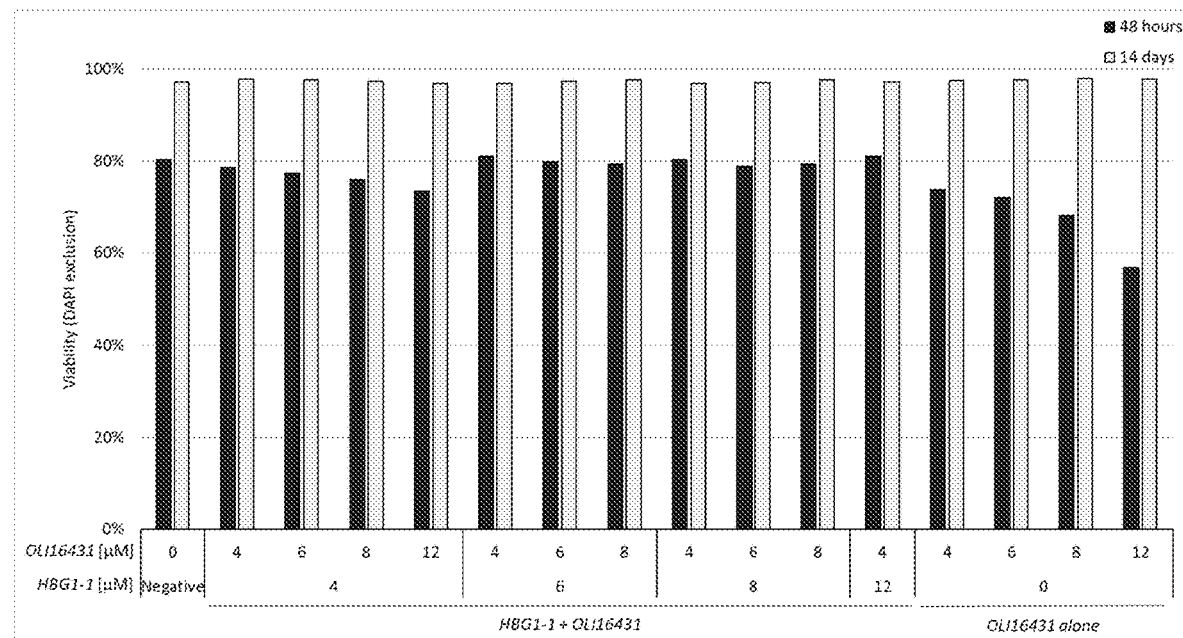

FIGS. 36A-B depicts total editing, HbF production, and viability results using different concentrations of RNP containing unmodified HBG1-1 gRNA (SEQ ID NO:1022, Table 14) complexed to His-AsCpf1-sNLS-sNLS H800A (SEQ ID NO: 1032, Table 14) ("His-AsCpf1-sNLS-sNLS H800A_HBG1-1 RNP," represented as "HBG1-1" in FIGS. 36A-B) co-delivered with different concentrations of ssODN OLI16431 (SEQ ID NO:1040, Table 11) (represented as "OLI16431" in FIGS. 36A-B) (Table 11). FIG. 36A depicts editing at the distal CAATT box (black bars (48 hours) and light grey bars (14 days of erythroid culture)) and HbF induction (black circles) after co-delivery of His-AsCpf1-sNLS-sNLS H800A_HBG1-1 RNP ("HBG1-1") and ssODN OLI16431 at varying concentrations. HbF levels are represented by black circles depicting expression levels of gamma-globin chains over total beta-like globin chains (gamma chains/[gamma chains+beta chain]) as measured by UPLC analysis on the erythroid progeny of mPB CD34+ cells. Bars depict the percentage of indels detected by NGS of the HBG PCR product at 48 hours (black) and 14 day erythroid culture (light grey) timepoints. FIG. 36B depicts viability of mPB CD34+ cells following delivery of His-AsCpf1-sNLS-sNLS H800A_HBG1-1 RNP alone ("HBG1-1"), ssODN OLI16431 alone, or in combination with varying doses of HBG1-1 and OLI16431. Viability was measured by DAPI exclusion at 48 hours post electroporation and after 14 days in erythroid culture. Following the editing of mPB CD34+ cells, ex vivo differentiation into the erythroid linage was performed for 18 days (Giarratana 2011). At day 14 of culture, a subset of cells were isolated and viability (DAPI exclusion) and editing (NGS of the HBG PCR product) measurements were taken.

Figure 37:
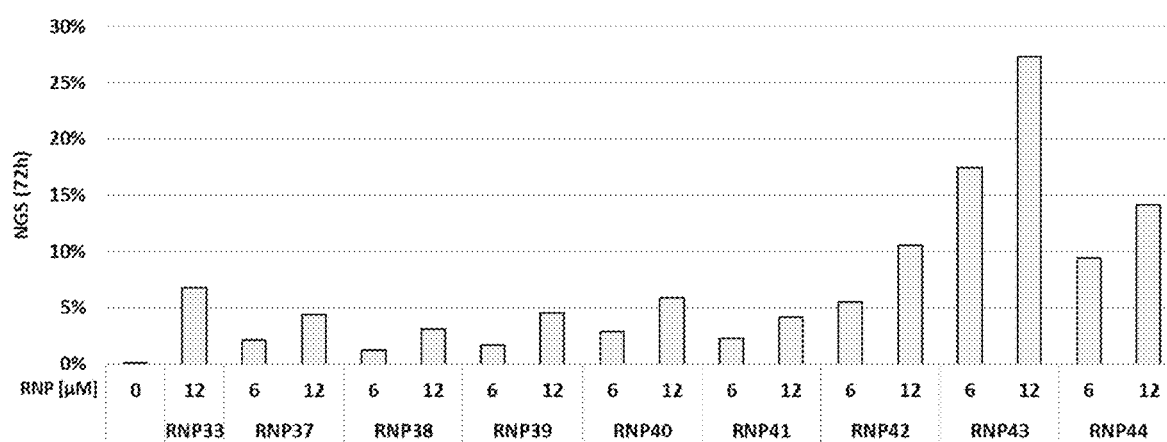

FIG. 37 depicts editing by RNP in mPB CD34+ cells. RNPs included gRNA complexed with Cpf1 protein as set forth in Table 21. Illumina sequencing was performed on isolated genomic DNA at 72 hours post electroporation.

Figure 38A:
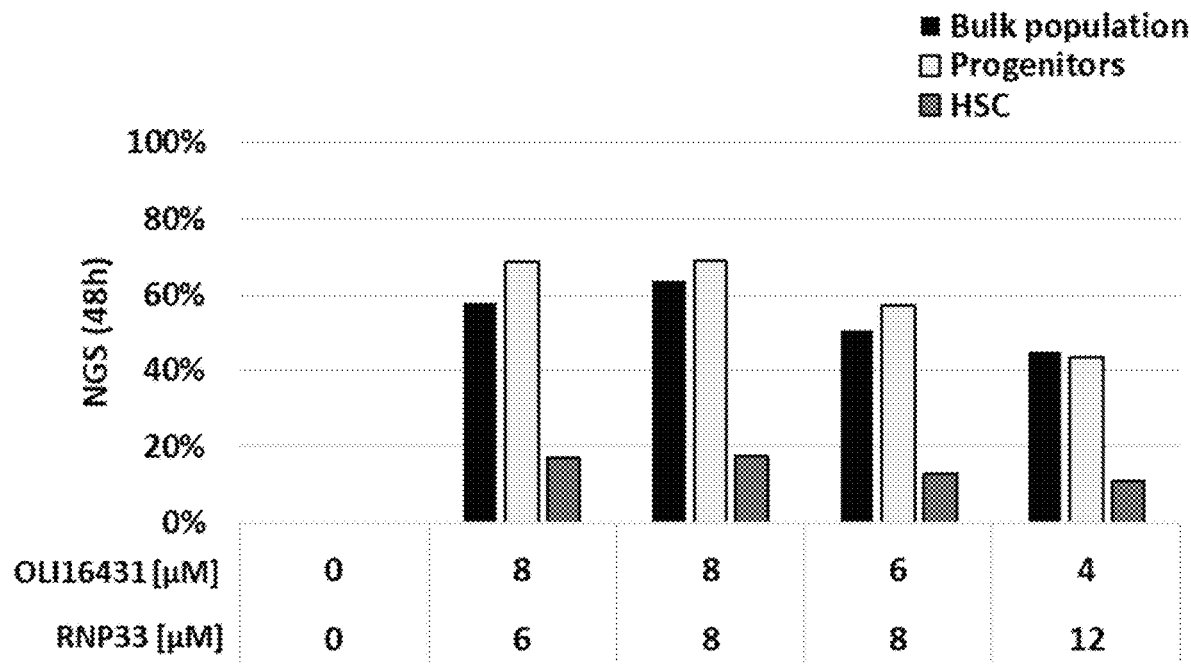
Figure 38B:
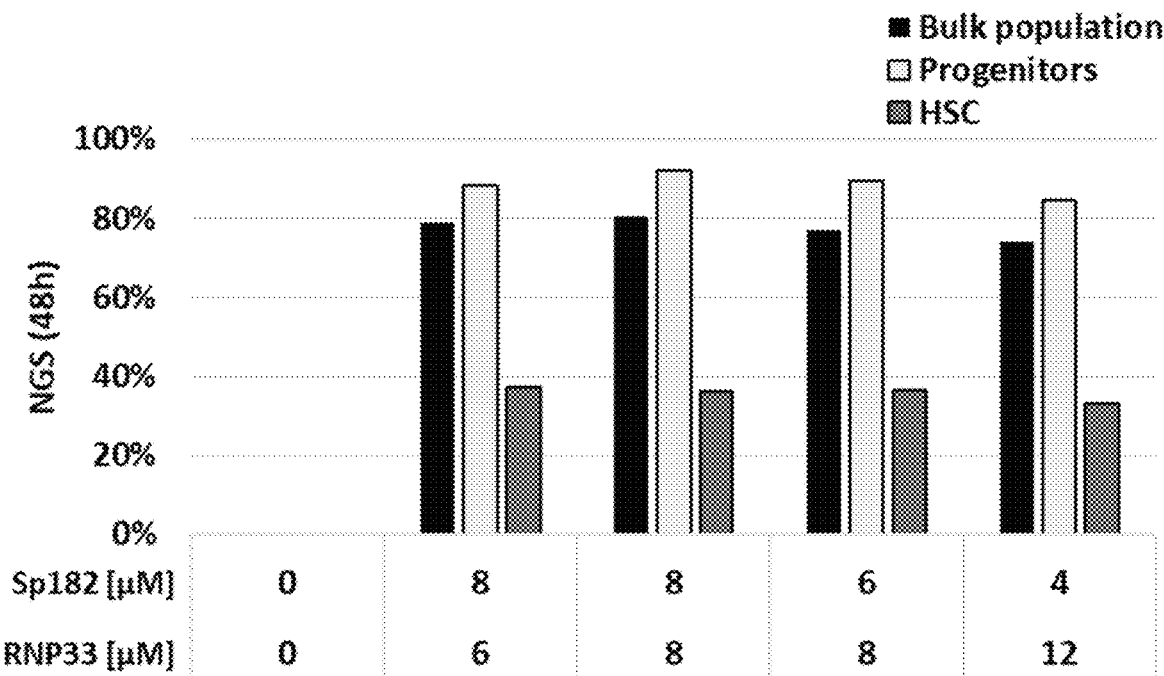

FIGS. 38A-B depict editing in bulk CD34+ cell population (black bars), progenitor cells (light grey bars), and HSCs (dark grey bars), as determined by Illumina sequencing 48 hours post electroporation. FIG. 38A depicts RNP33 (Table 21) delivered alone or co-delivered with ssODN OLI16431 (SEQ ID NO:1040, Table 11). FIG. 38B depicts RNP33 (Table 21) delivered alone or co-delivered with Sp182 RNP (dead gRNA comprising SEQ ID NO: 1027 (Table 14) complexed with S. pyogenes Cas9 (SEQ ID NO:1033)).

Figure 39:
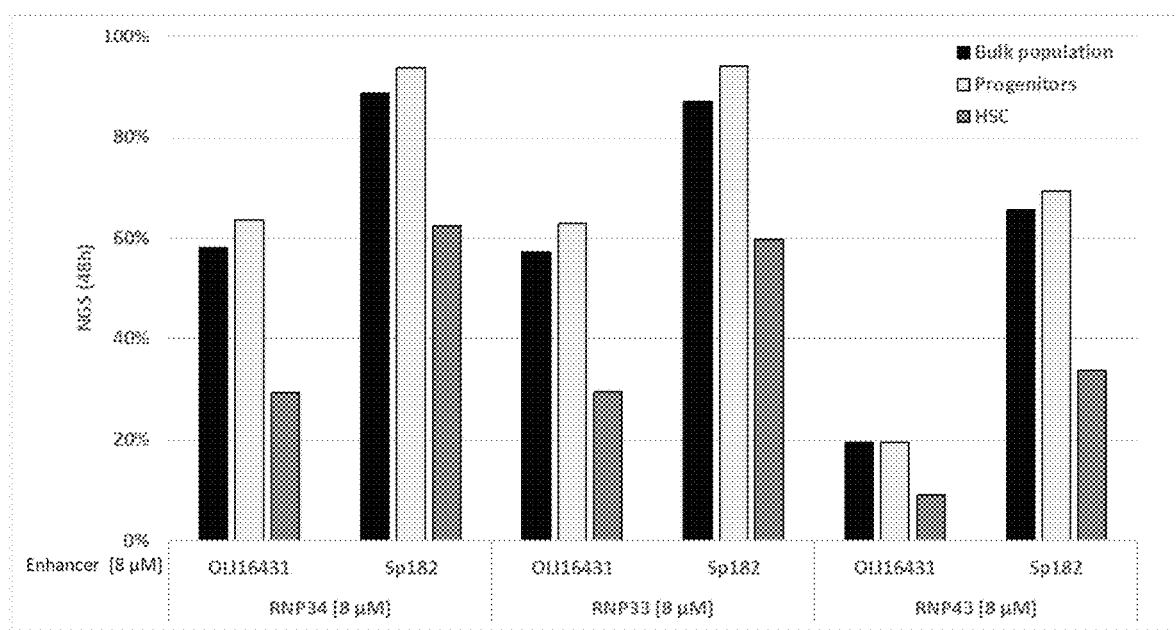

FIG. 39 depicts editing in bulk CD34+ cell population (black bars), progenitor cells (light grey bars), and HSCs (dark grey bars), as determined by Illumina sequencing 48 hours post electroporation. RNP34, RNP33, and RNP43 (Table 21) were delivered alone or in combination with Sp182 RNP (dead gRNA comprising SEQ ID NO:1027 (Table 14) complexed with S. pyogenes Cas9 (SEQ ID NO: 1033)) or ssODN OLI16431 (SEQ ID NO: 1040, Table 11).

Figure 40:
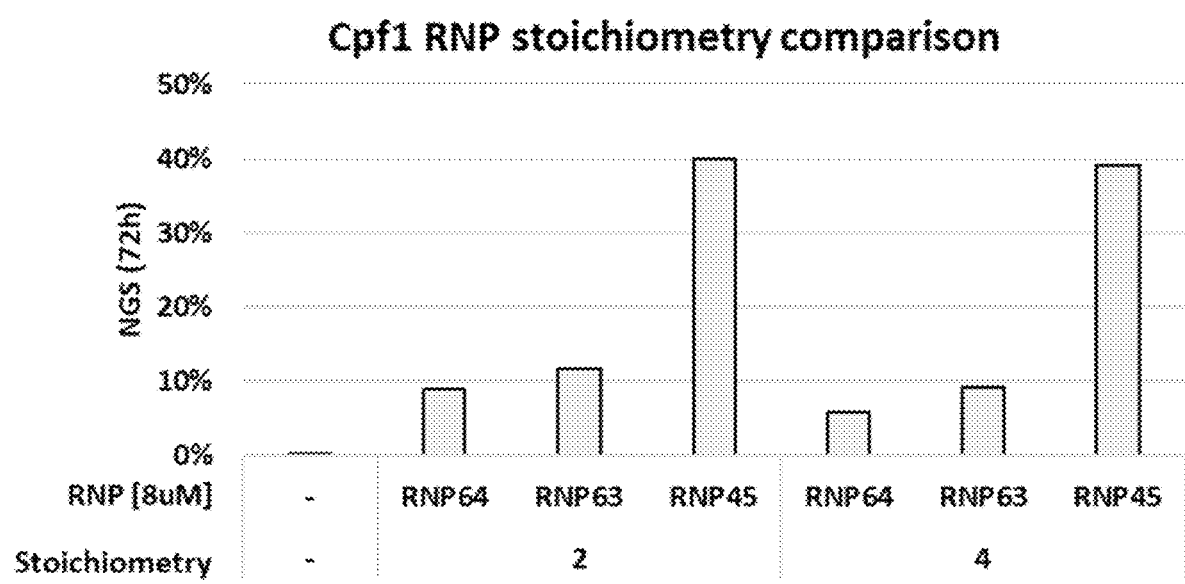

FIG. 40 depicts editing in CD34+ cells as determined by Illumina sequencing 72 hours post electroporation. RNP64, RNP63, and RNP45 (Table 21) were delivered at a stoichiometry (gRNA:Cpf1 complexation ratio) of either 2, or 4, where the gRNA is in a molar excess.

Figure 41:
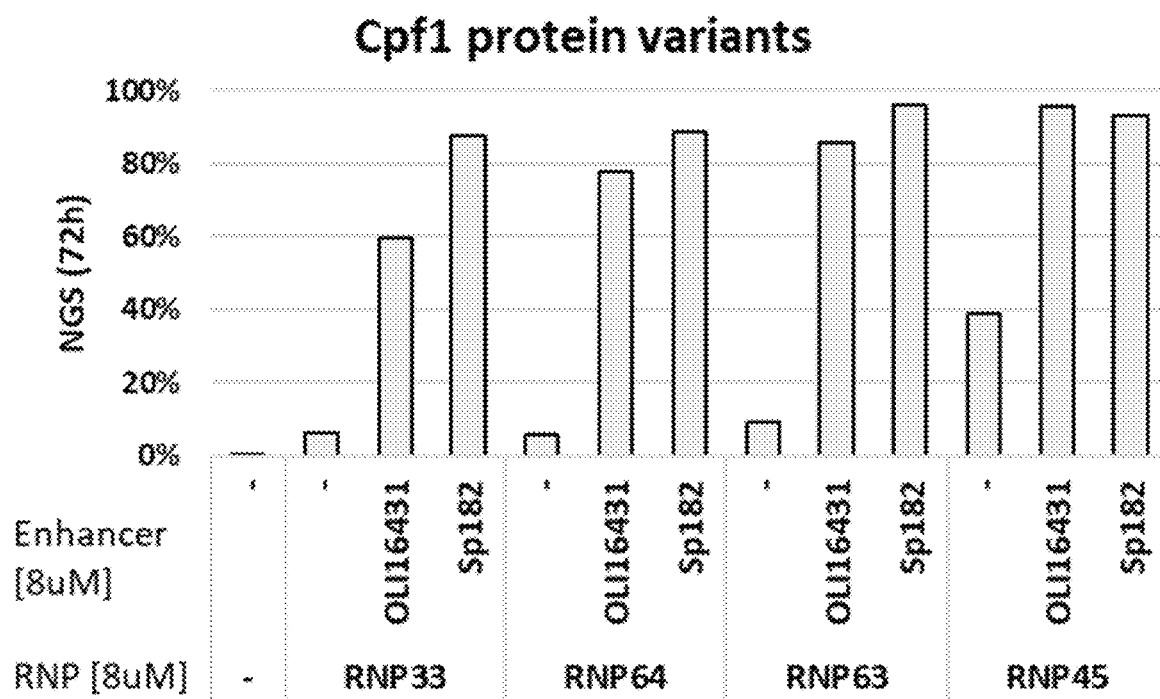

FIG. 41 depicts editing in CD34+ cells as determined by Illumina sequencing 72 hours post electroporation. RNP33, RNP64, RNP63, and RNP45 (Table 21) were delivered alone or in combination with Sp182 RNP (dead gRNA comprising SEQ ID NO:1027 (Table 14) complexed with S. pyogenes Cas9 (SEQ ID NO: 1033)) or ssODN OLI16431 (SEQ ID NO: 1040, Table 11).

Figure 42:
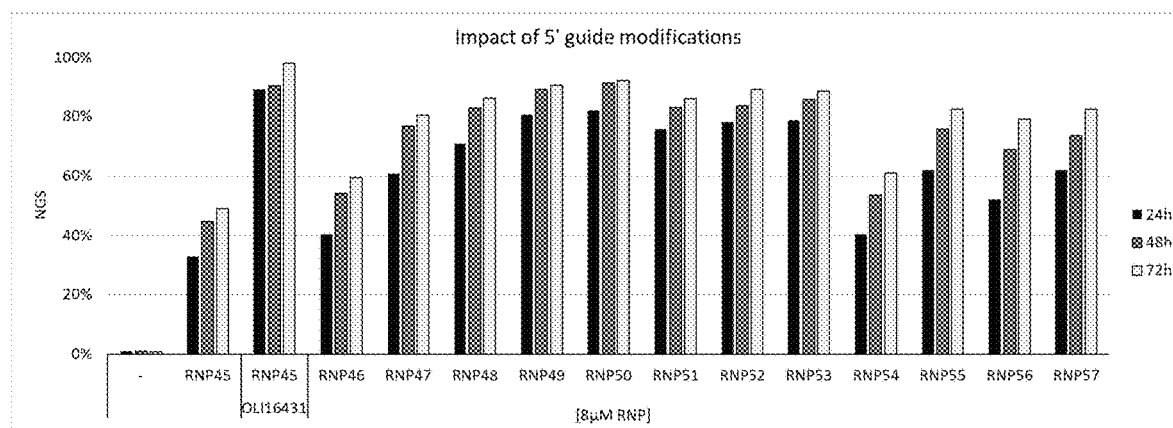

FIG. 42 depicts editing in CD34+ cells as determined by Illumina sequencing. RNPs comprising Cpf1 (SEQ ID:1094) complexed to gRNAs with various 5' DNA extensions (Table 21), were delivered alone or in combination with 8 μM OLI16431 (SEQ ID NO:1040, Table 11).

Figure 43:
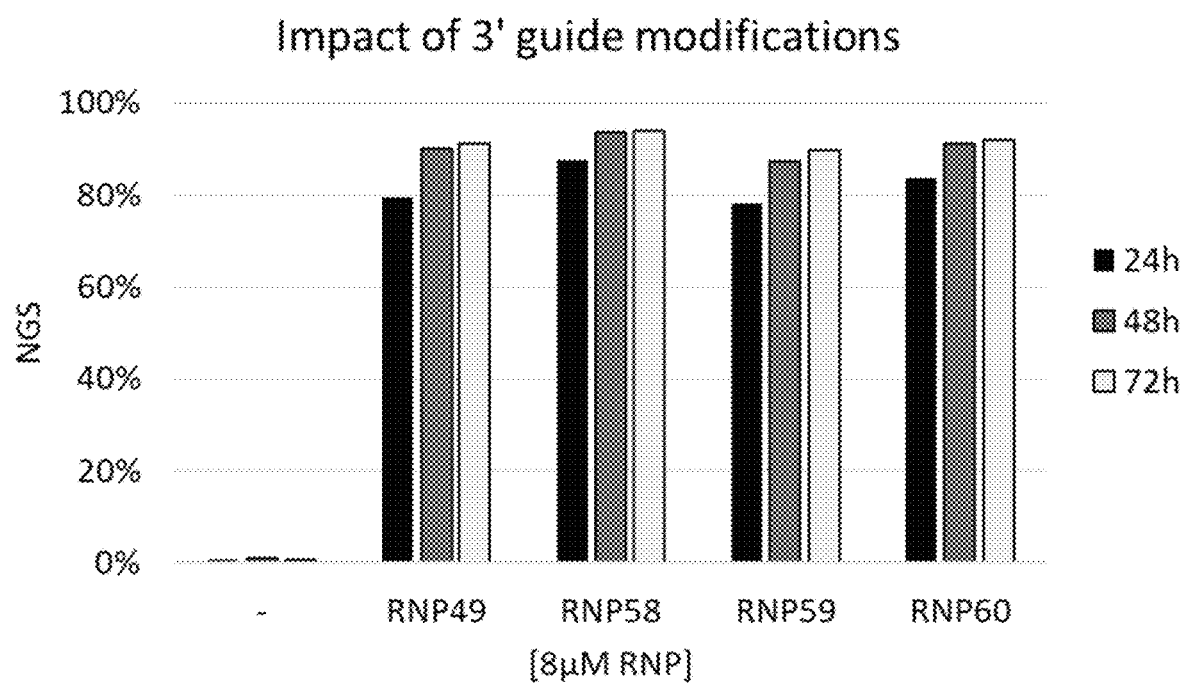

FIG. 43 depicts editing in CD34+ cells, as determined by Illumina sequencing. RNPs comprising gRNAs with matched 5' ends (RNP49 vs RNP58 and RNP59 vs RNP60, Table 21) were delivered to CD34+ cells to assess the impact of 3' modifications. In both comparisons, gRNAs with 3' PS-OMe outperformed the unmodified 3' version at 24 hours post electroporation.

Figure 44A:
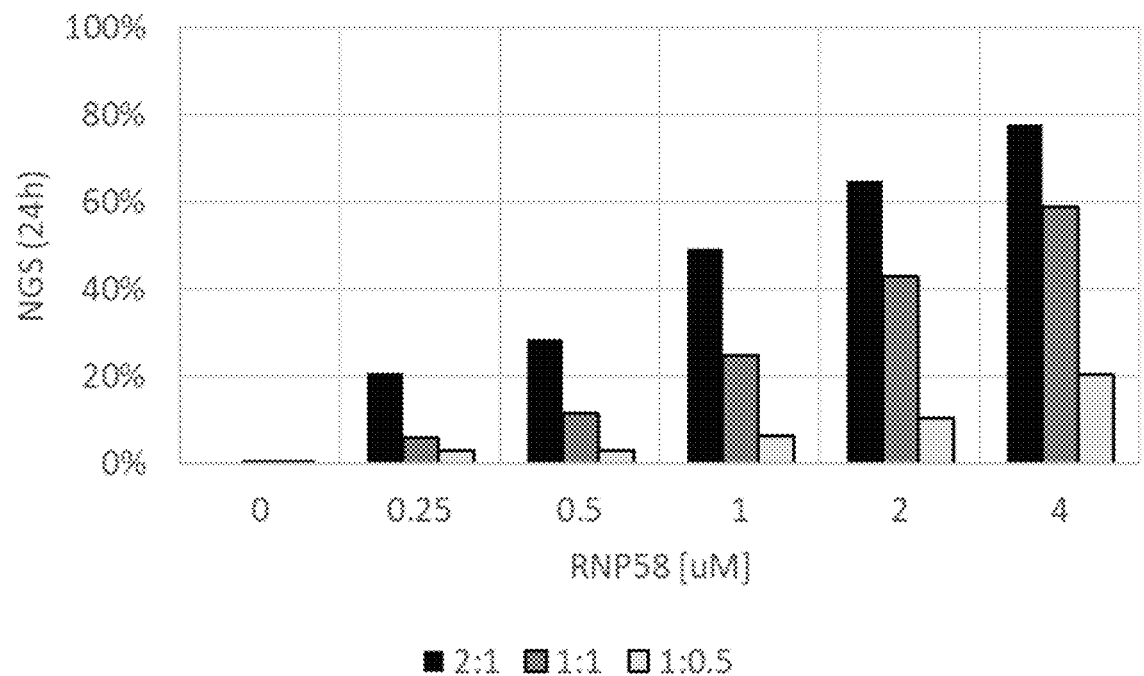
Figure 44B:
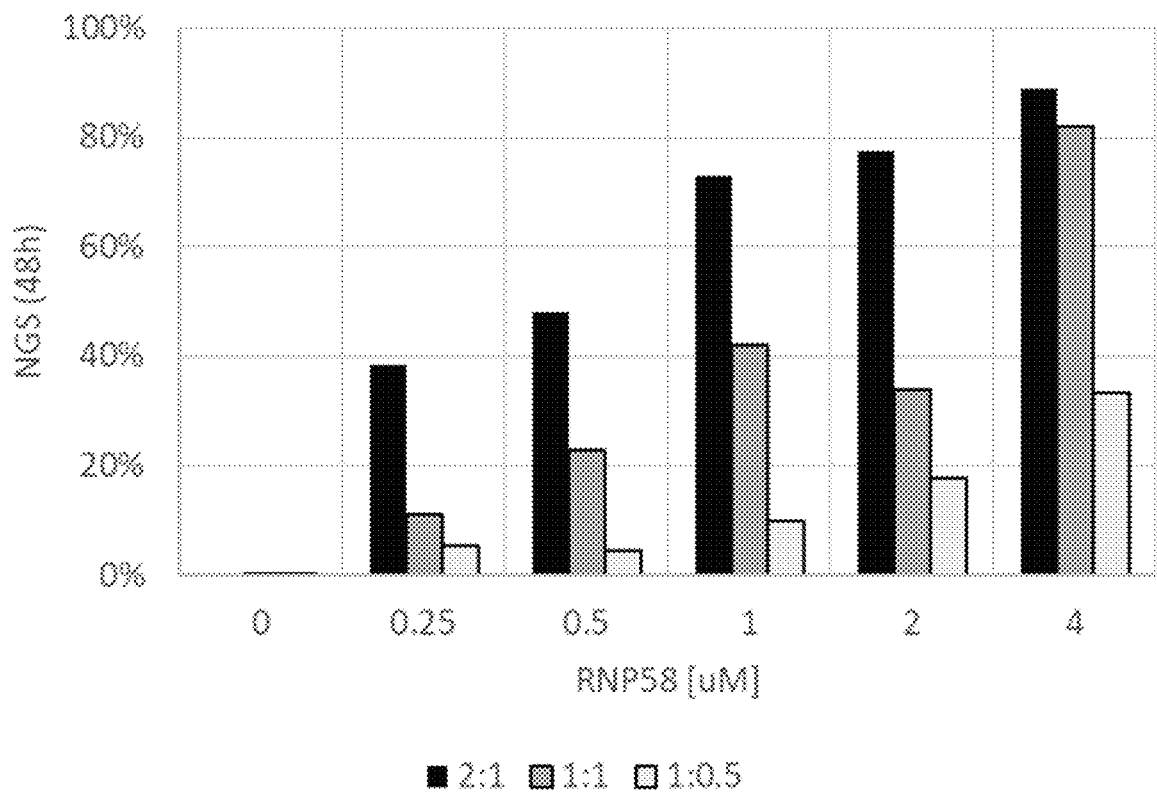

FIGS. 44A-B depict editing in CD34+ cells as determined by Illumina sequencing 24 and 48 hours post electroporation. RNP58 (Table 21) was delivered to CD34+ cells at a stoichiometry (gRNA:Cpf1 complexation ratio) of either 2:1, 1:1 or 0.5:1 molar ratios. At all doses tested, editing was best when RNP was complexed at 2:1 ratio.

Figure 45A:
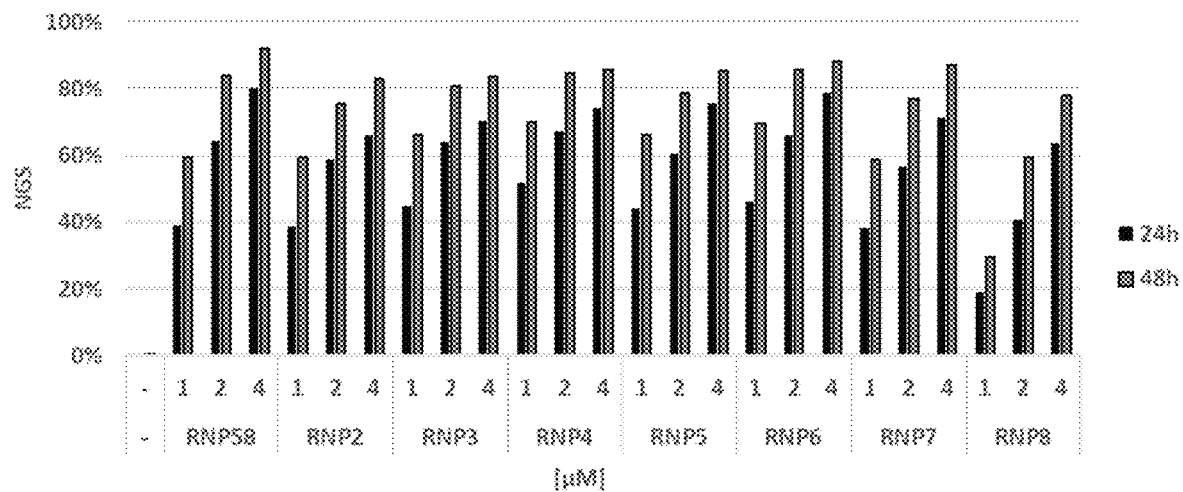
Figure 45B:
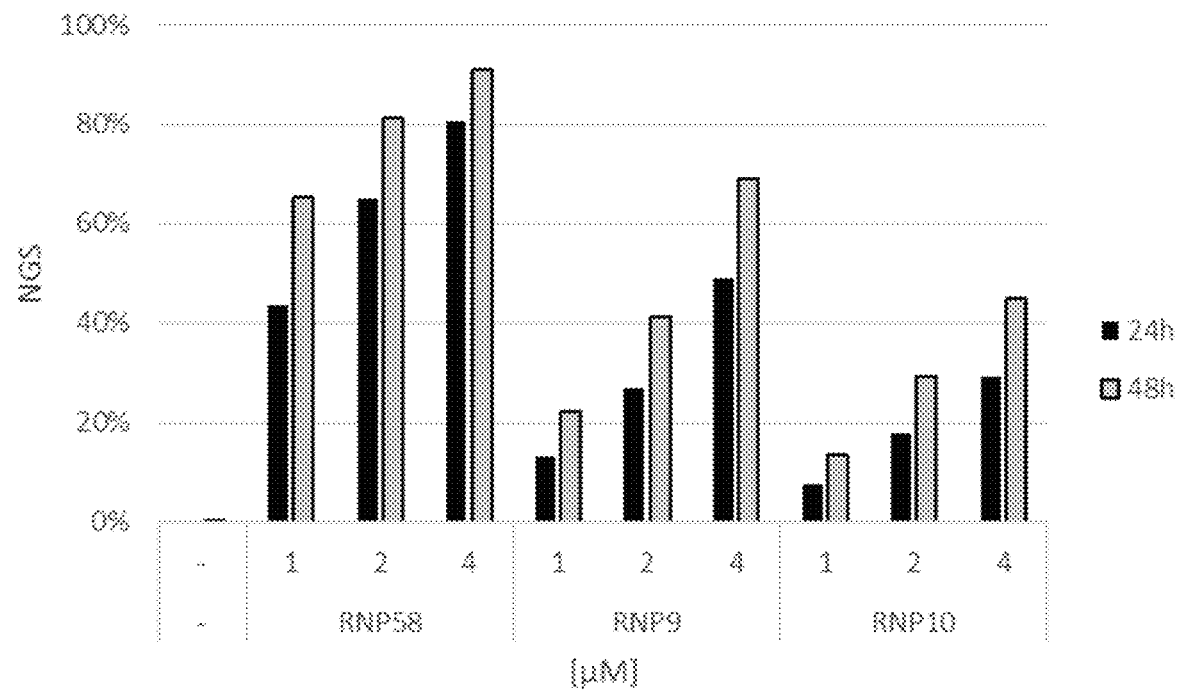

FIGS. 45A-B depict editing in CD34+ cells as determined by Illumina sequencing. FIGS. 45A and 45B depict RNPs comprising gRNAs with matched 5' ends, but different 3' modifications (Table 21) delivered to CD34+ cells to assess the impact of 3' modifications or extensions.

Figure 46A:
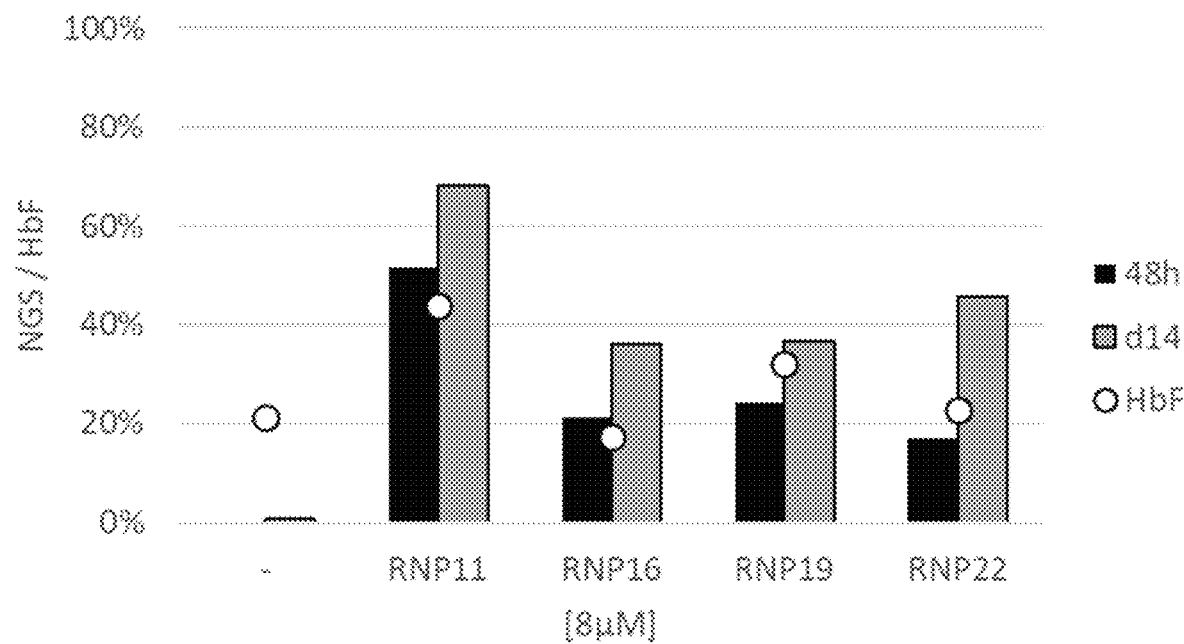
Figure 46B:
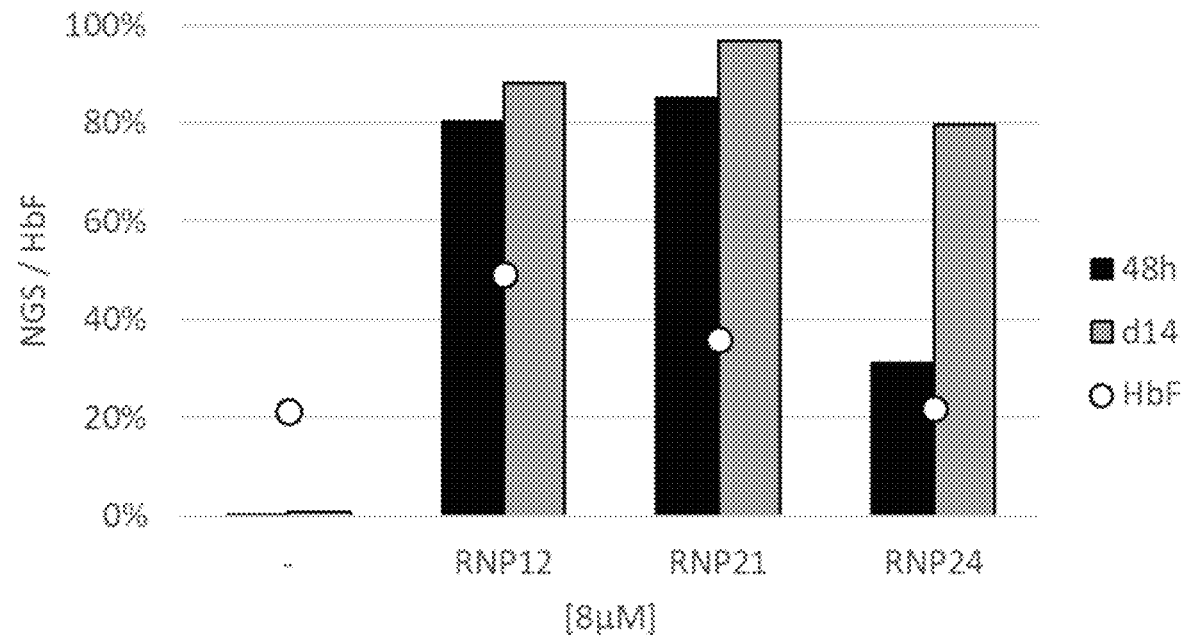

FIGS. 46A-C depict editing in CD34+ cells and their erythroid progeny, and HbF levels in the erythroid progeny following delivery of RNPs targeting various cut sites within the HBG locus. FIG. 46A depicts RNPs comprising guide RNAs containing an unmodified 5' and 1×PS-Ome at the 3' end (Table 21). FIG. 46B depicts RNPs comprising guide RNAs containing 2PS+20 DNA extension at the 5' and 1×PS-Ome at the 3' end (Table 21). FIG. 46C depicts RNPs comprising guide RNAs containing a 25 DNA extension at the 5' and 1×PS-Ome at the 3' end (Table 21).

Figure 47:
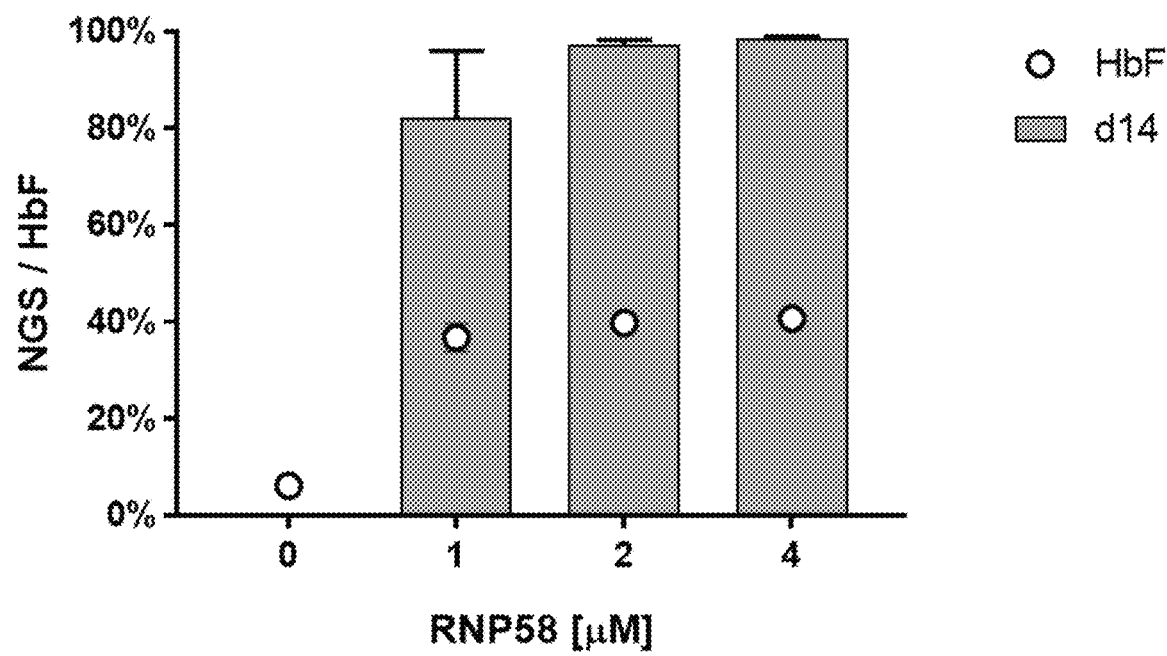

FIG. 47 depicts editing and HbF levels in erythroid progeny of CD34+ cells following delivery of RNP58 at 1 μM, 2 μM, and 4 μM.

Figure 48:
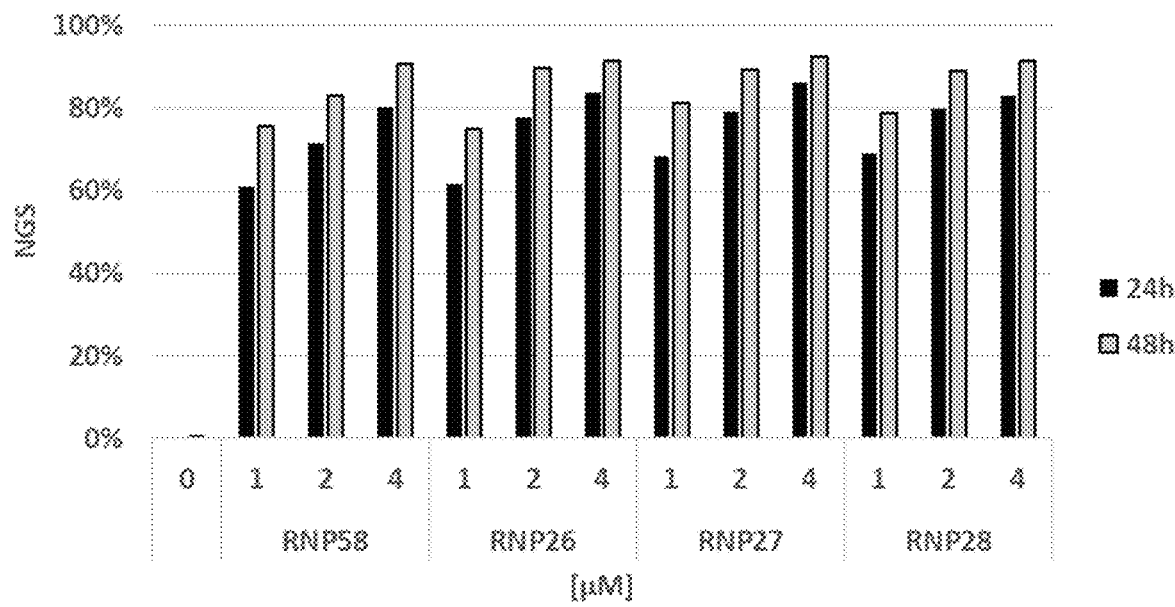

FIG. 48 depicts editing in CD34+ cells following Maxcyte electroporation of RNPs. RNP58, RNP26, RNP27, and RNP28 comprising gRNA SEQ ID: 1051 complexed to different Cpf1 proteins (SEQ IDs: 1094, 1096, 1107, 1108) (Table 21) were delivered into CD34+ cells. Editing was determined by Illumina-sequencing 24 and 48 hours post electroporation.

Figure 49:
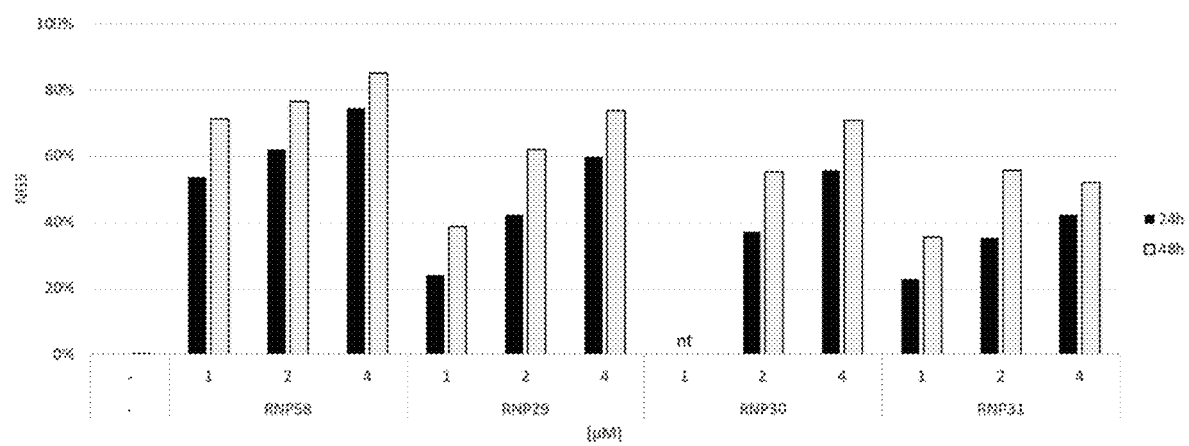

FIG. 49 depicts editing in CD34+ cells following Maxcyte electroporation of RNPs. RNP58, RNP29, RNP30, and RNP31 comprising Cpf1 protein SEQ ID: 1094 complexed to guide RNAs with various 5' extensions (Table 21) were delivered into CD34+ cells. Editing was determined by Illumina-seq 24 and 48 hours post electroporation. RNP30 was not tested (nt) at 1 μM due to limiting cell numbers.

Figure 50:
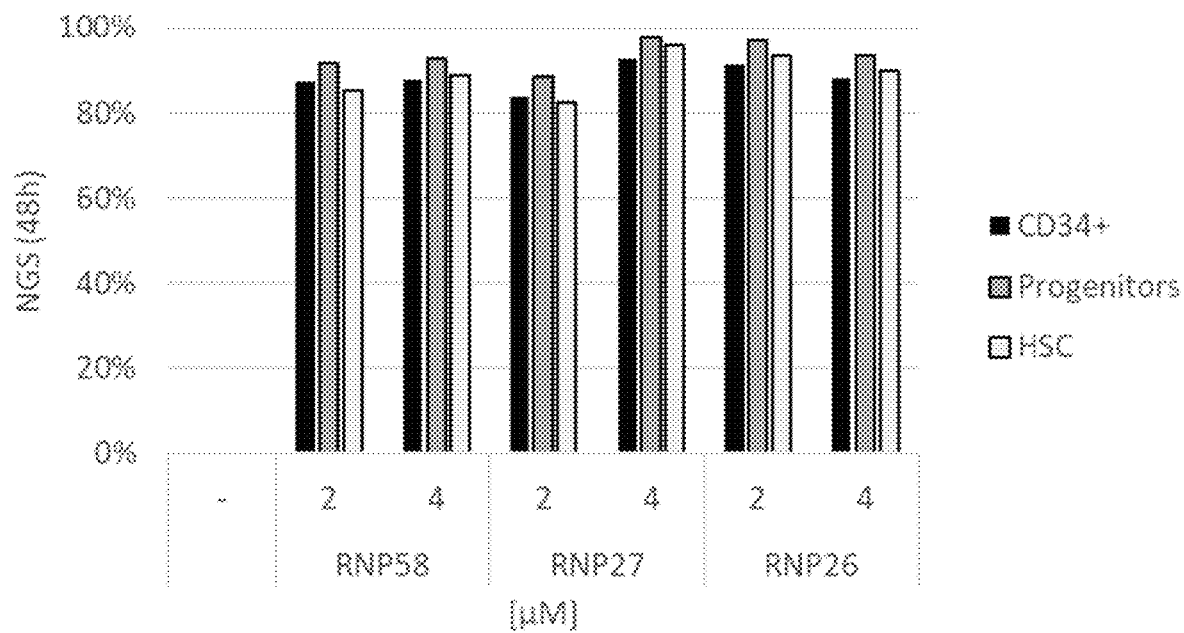

FIG. 50 depicts editing in bulk CD34+ cell population (black bars), progenitor cells (dark grey bars), and HSCs (light grey bars), as determined by Illumina sequencing 48 hours post electroporation. RNP58, RNP27, and RNP26 (Table 21) were delivered to CD34+ cells at 2 μM or 4 μM.

Figure 51:
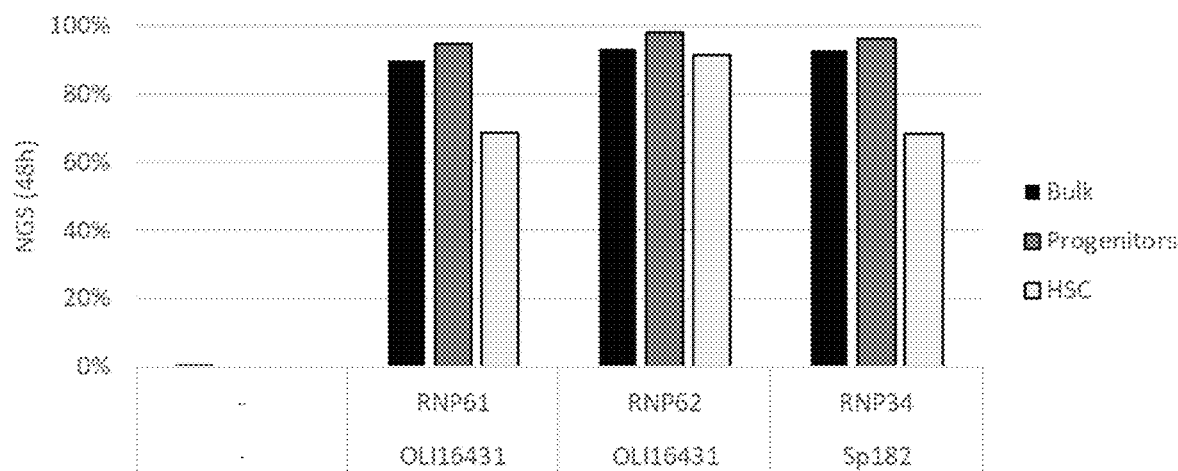

FIG. 51 depicts editing in bulk CD34+ cell population (black bars), progenitor cells (dark grey bars), and HSCs (light grey bars), as determined by Illumina sequencing 48 hours post electroporation. RNP61, RNP62, and RNP34 (Table 21) (8 μM) were co-delivered to CD34+ cells with ssODN OLI16431 (SEQ ID NO:1040, Table 11) (8 μM).

Figure 52:
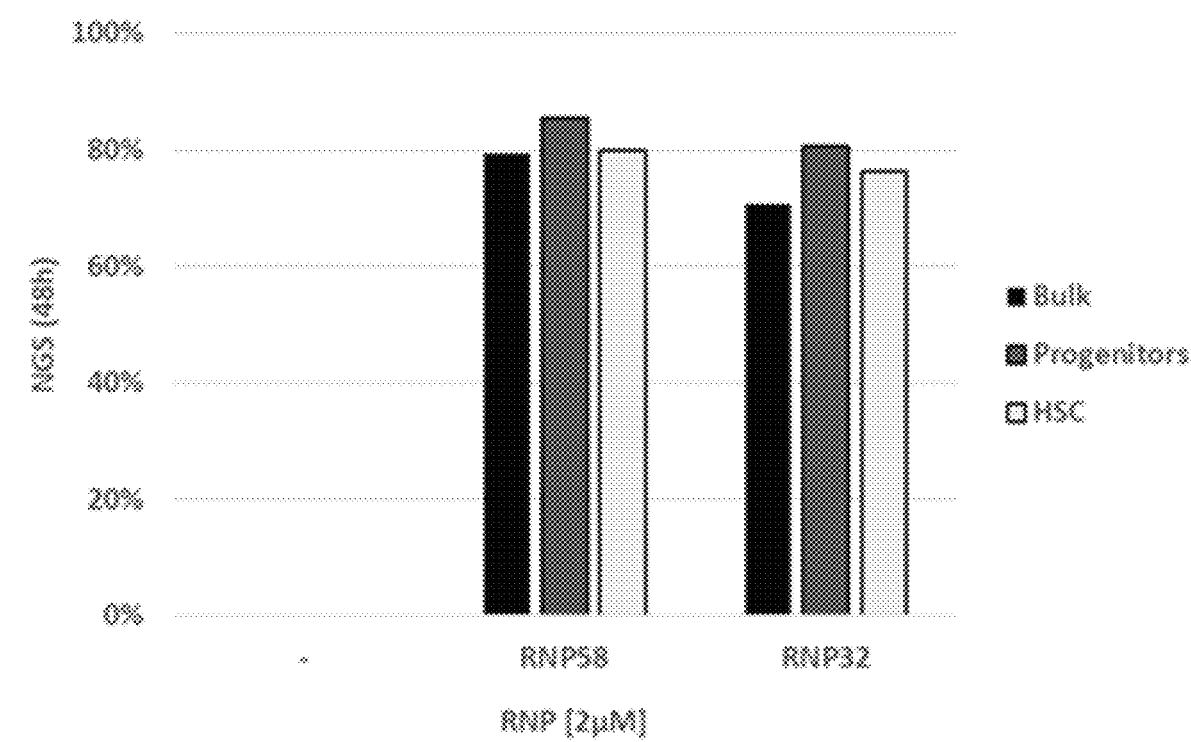

FIG. 52 depicts editing in bulk CD34+ cell population (black bars), progenitor cells (dark grey bars), and HSCs (light grey bars), as determined by Illumina sequencing 48 hours post electroporation. RNP58 and RNP32 (Table 21) were delivered to CD34+ cells at 2 μM.

Figure 53:
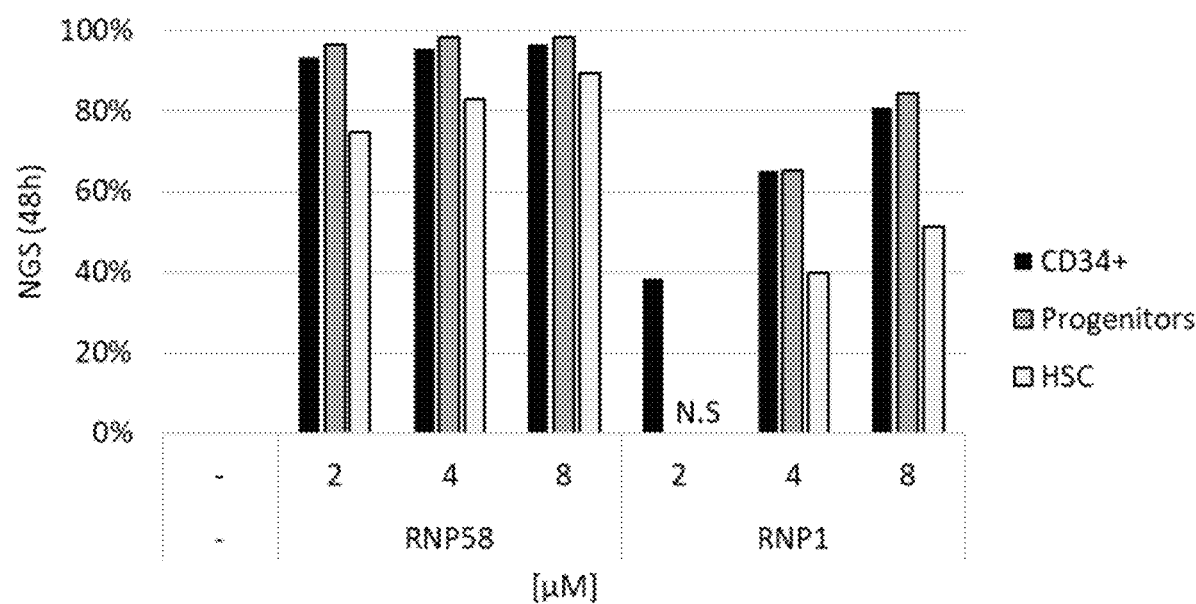

FIG. 53 depicts editing in bulk CD34+ cell population (black bars), progenitor cells (dark grey bars), and HSCs (light grey bars), as determined by Illumina sequencing 48 hours post electroporation. RNP58 and RNP1 (Table 21) were delivered to CD34+ cells at 2 μM, 4 μM, or 8 μM. The cells edited with RNP1 at 2 μM were not sorted (N.S), and thus editing data is not available.

Figure 54:
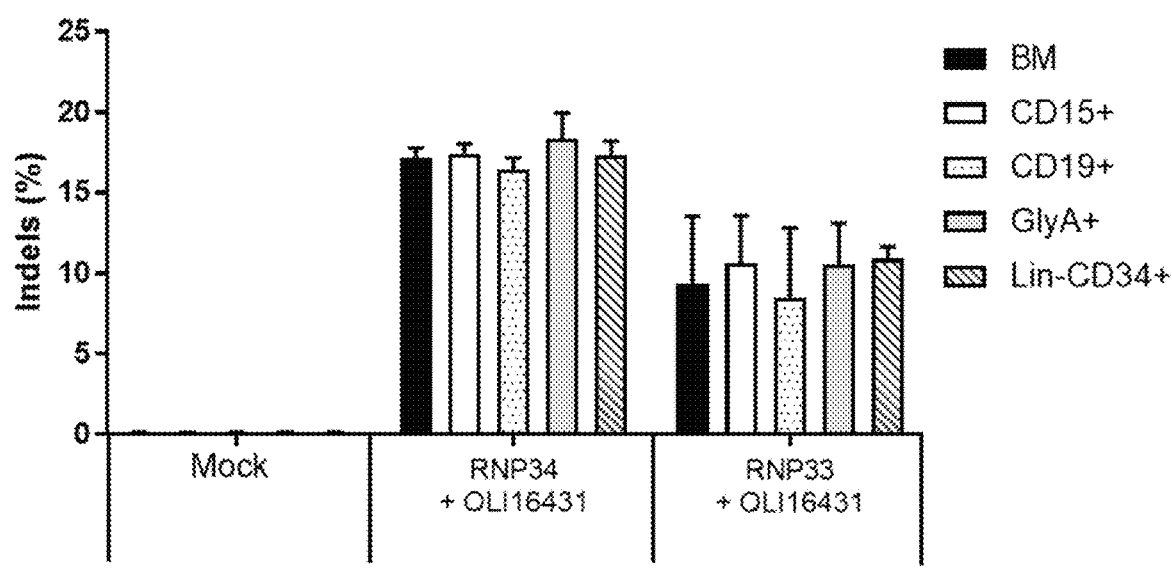

FIG. 54 depicts the indels of engrafted mPB CD34+ cells from BM of "NBSGW" mice 8 weeks post infusion of electroporated cells. RNP34 and RNP33 (Table 21) (8 μM) were co-delivered to CD34+ cells with ssODN OLI16431 (SEQ ID NO:1040, Table 11) (6 μM).

Figure 55A:
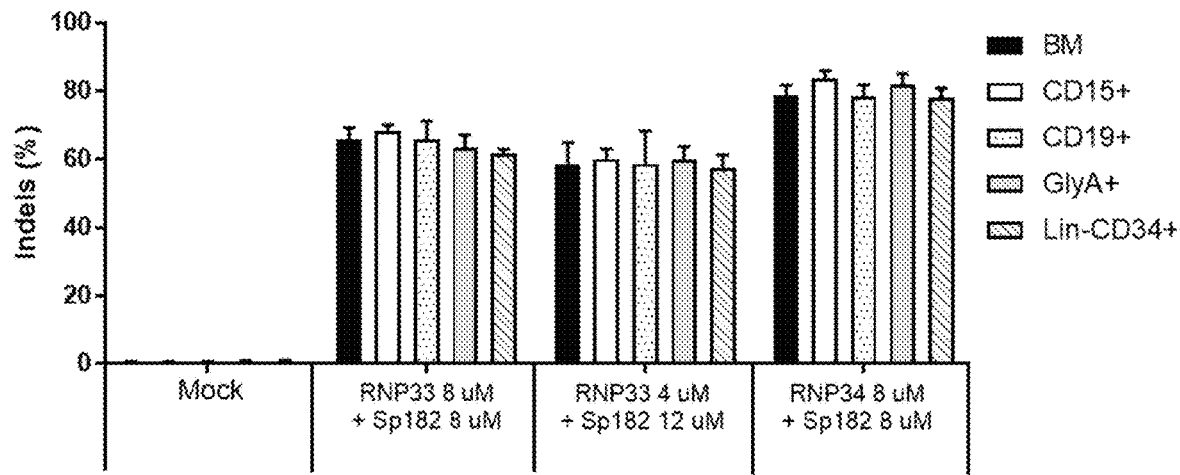
Figure 55B:
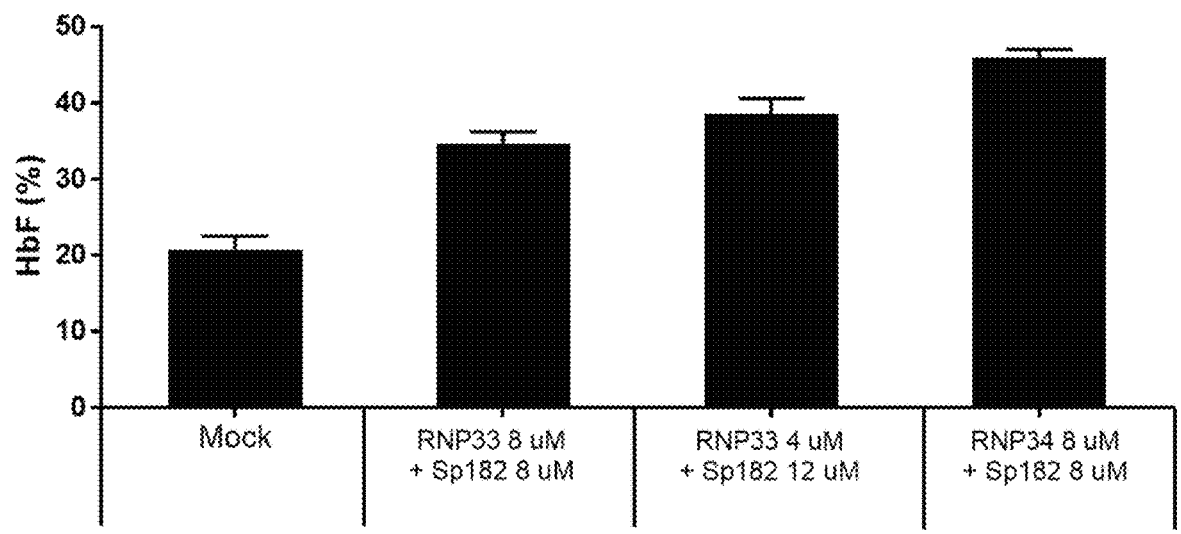

FIGS. 55A-B depict the indels of engrafted mPB CD34+ cells and HbF expression by erythroid cells derived from chimeric BM of "NBSGW" mice 8 weeks post infusion of electroporated cells. RNP33 or RNP34 (Table 21) was co-delivered with Sp182 RNP (dead gRNA comprising SEQ ID NO: 1027 (Table 14) complexed with S. pyogenes Cas9 (SEQ ID NO:1033)) (16 μM total RNP) to CD34+ cells. FIG. 55A depicts the indel frequency in unfractionated bone marrow or flow-sorted individual populations of CD15+, CD19+, GlyA+, and Lin-CD34+ cells in mock-transfected (no RNP added) or RNP transfected cells. Lin-CD34+ cells are defined as CD34+ cells that are negative for CD3, CD14, CD15, CD16, CD19, CD20, and CD56) from bone marrow (BM) of nonirradiated NOD, B6.SCID Il2rγ-/- Kit(W41/W41) ("NBSGW") mice infused with mock (no RNP) or RNP transfected mPB CD34+ cells. Indels were determined for each cell population by Illumina sequencing. FIG. 55B depicts the HbF expression, calculated by UPLC as gamma/beta-like (%) from erythroid cell lysates following an 18-day erythroid differentiation culture from total chimeric BM.

Figure 56A:
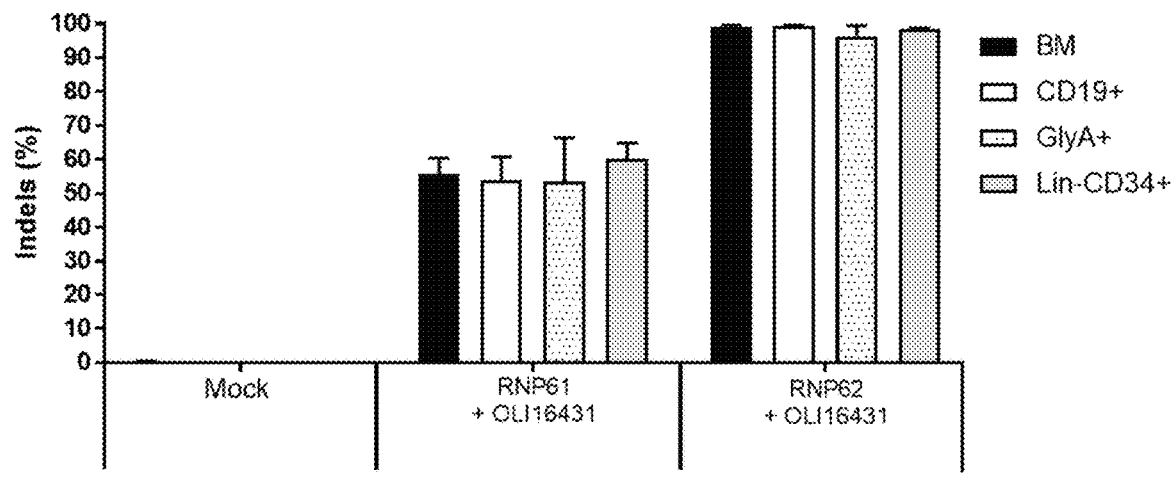
Figure 56B:
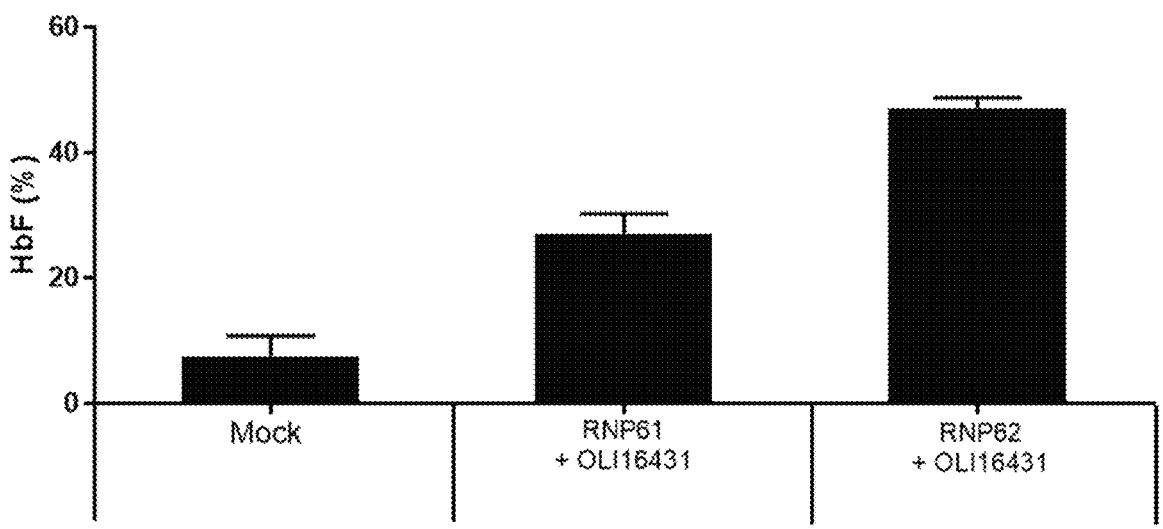

FIGS. 56A-B depict the indels of engrafted mPB CD34+ cells and HbF expression by erythroid cells derived from chimeric BM of "NBSGW" mice 8 weeks post infusion of electroporated cells. RNP61 or RNP62 (Table 21) (8 μM) was co-delivered with ssODN OLI16431 (SEQ ID NO:1040, Table 11) (8 μM) to CD34+ cells. FIG. 56A depicts the indels of unfractionated bone marrow or flow-sorted individual populations of CD15+, CD19+, GlyA+, and Lin-CD34+ cells in mock-transfected (no RNP added) or RNP transfected cells. Lin-CD34+ cells are defined as CD34+ cells that are negative for CD3, CD14, CD15, CD16, CD19, CD20, and CD56) from bone marrow (BM) of nonirradiated NBSGW mice infused with mock (no RNP) or RNP transfected mPB CD34+ cells. Indels were determined for each cell population by Illumina sequencing. FIG. 56B depicts the HbF expression, calculated by UPLC as gamma/beta-like (%) by erythroid cells following an 18-day erythroid differentiation culture from total chimeric BM.

Figure 57:
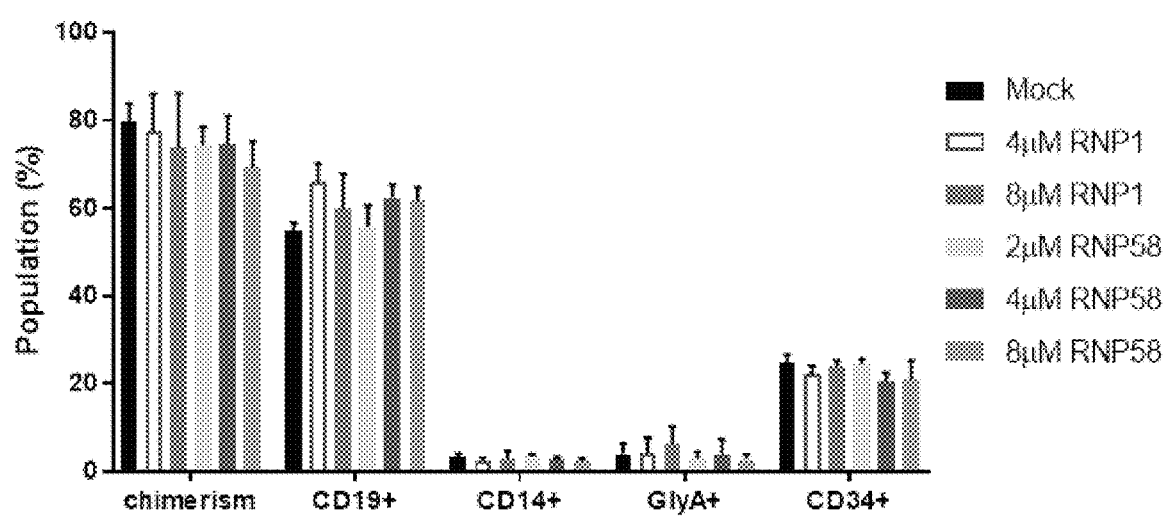

FIG. 57 depicts human chimerism within bone marrow 8 weeks post infusion with mock (no RNP added) mPB CD34+ cells, or mPB CD34+ cells edited with RNP1 (4 or 8 μM) or RNP58 (2, 4 or 8 μM) (table 21). Human chimerism and lineage reconstitution (CD45+, CD14+, CD19+, glycophorin A (GlyA, CD235a+), lineage, and CD34+, and mouse CD45+ marker expression) in BM was determined by flow cytometry.

Figure 58:
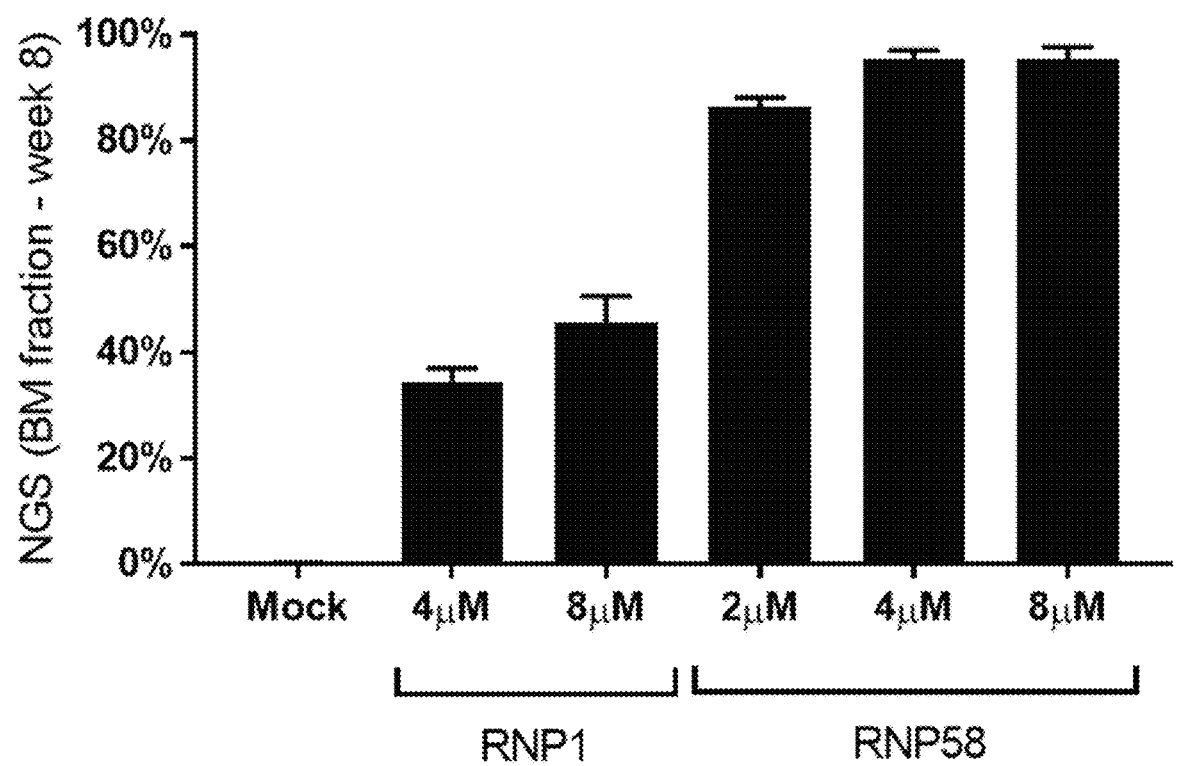

FIG. 58 depicts indels within unsorted bulk bone marrow 8 weeks post infusion with mock (no RNP added) mPB CD34+ cells, or mPB CD34+ cells edited with RNP1 (4 or 8 μM) or RNP58 (2, 4 or 8 μM) (table 21). Indels were determined by Illumina sequencing.

Figure 59:
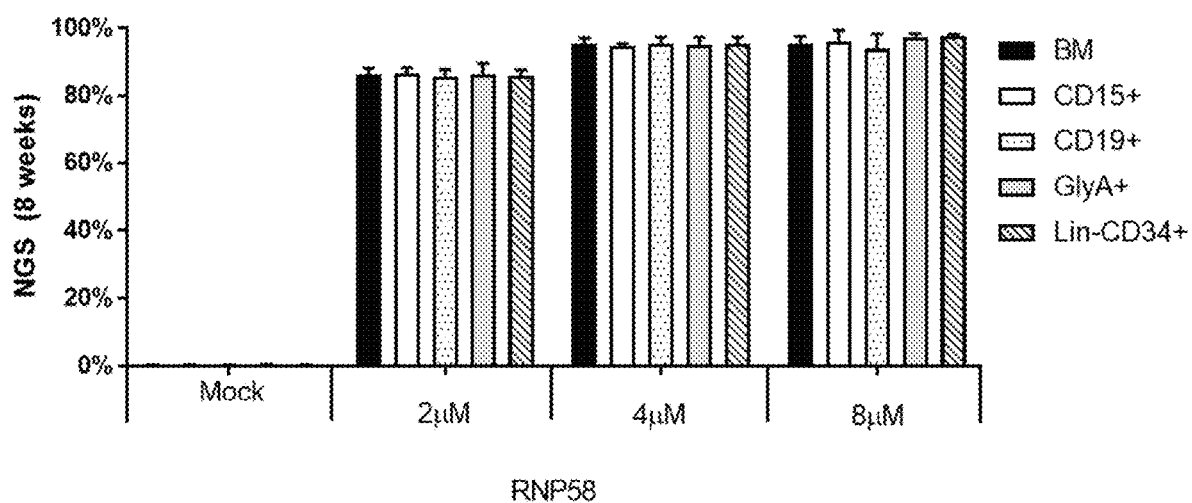

FIG. 59 depicts the indel frequency in unfractionated bone marrow or flow-sorted individual populations of CD15+, CD19+, GlyA+, and Lin-CD34+ cells in mock-transfected (no RNP added) or RNP transfected cells. Lin- CD34+ cells are defined as CD34+ cells that are negative for CD3, CD14, CD15, CD16, CD19, CD20, and CD56 from bone marrow (BM) of nonirradiated NOD, B6.SCID Il2rγ-/- Kit(W41/W41) ("NBSGW") mice infused with mock (no RNP) or RNP transfected mPB CD34+ cells. Indels were determined for each cell population by Illumina sequencing.

Figure 60:
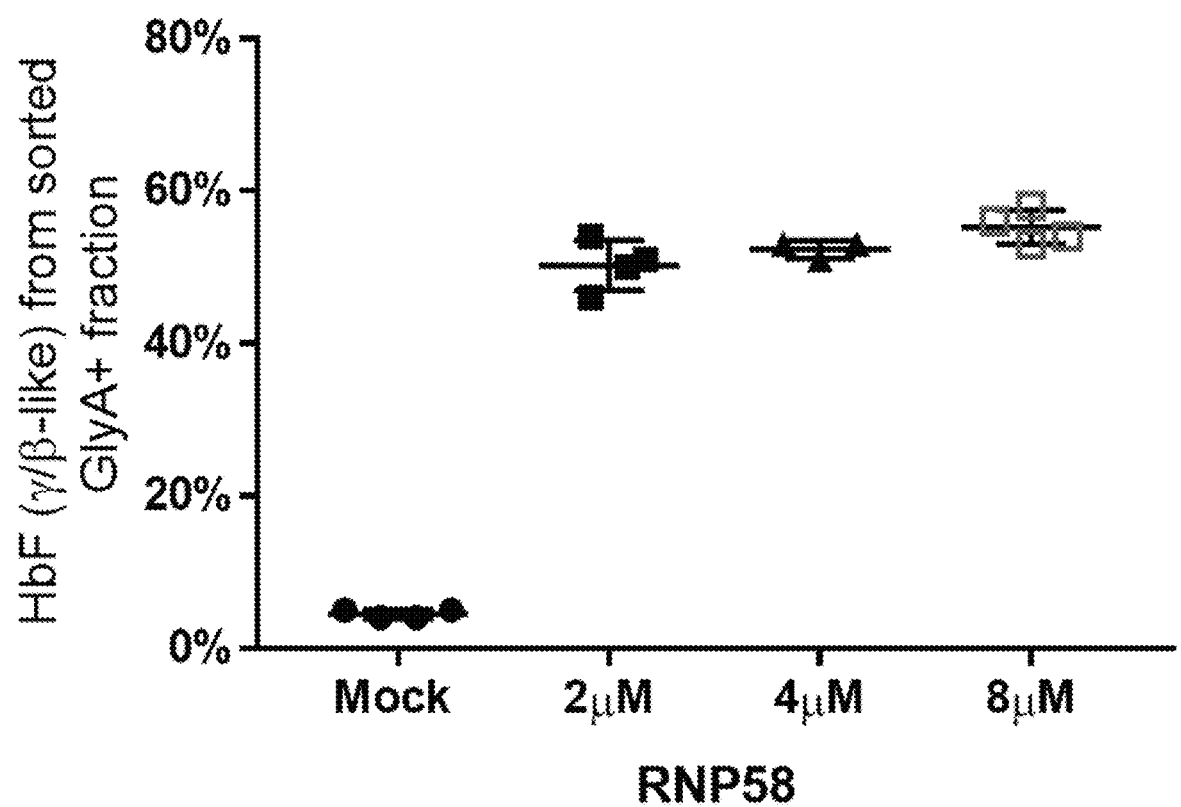

FIG. 60 depicts HbF from GlyA+ fraction isolated from bone marrow at 8 weeks post infusion with mock (no RNP added) mPB CD34+ cells, or mPB CD34+ cells edited with RNP58 (2, 4 or 8 µM) (table 21).

Figure 61:
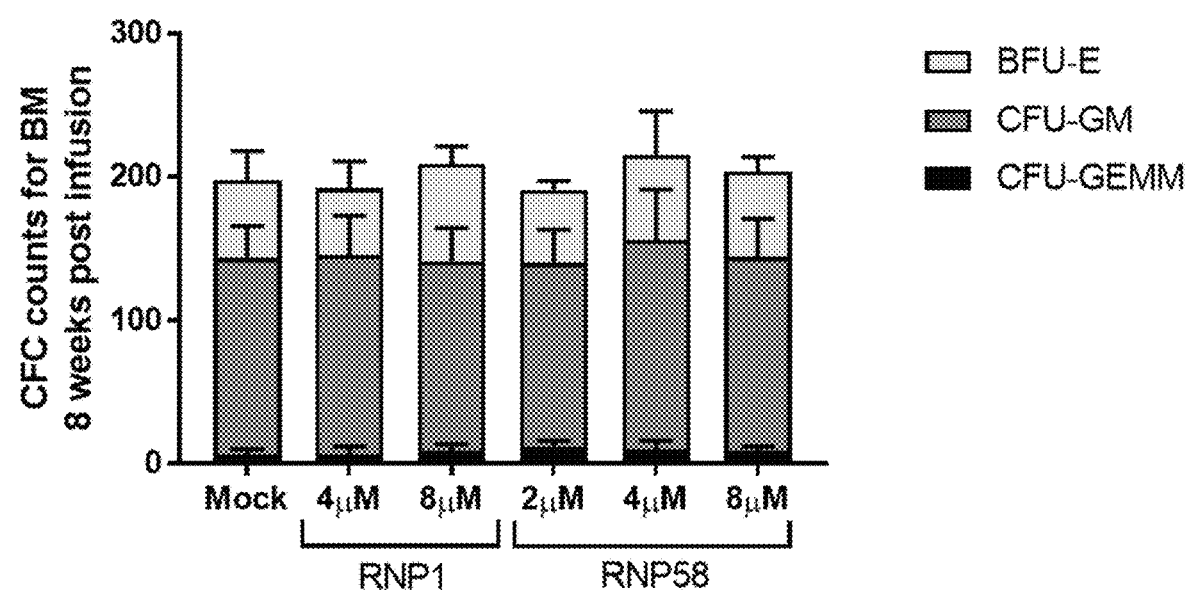

FIG. 61 depicts colony forming potential of cells from bone marrow flushes taken 8 weeks post infusion of mock or edited human mobilized CD34+ cells. The number and subtype of colonies are indicated (GEMM: granulocyte-erythroid-monocyte-macrophage colony (black), GM: granulocyte-macrophage colony (dark grey), E: erythroid colony (light grey)).

FIG. 62 depicts the sequences of Cpf1 protein variants set forth in Table 20. Nuclear localization sequences are shown as bolded letters, six-histidine sequences are shown as underlined letters. Additional permutations of the identity and N-terminal/C-terminal positions of NLS sequences, e.g., appending two or more nNLS sequences or combinations of nNLS and sNLS sequences (or other NLS sequences) to either the N-terminal/C-terminal positions, as well as sequences with and without purification sequences, e.g., six-histidine sequences, are within the scope of the instantly disclosed subject matter.

DETAILED DESCRIPTION

Definitions and Abbreviations

Unless otherwise specified, each of the following terms has the meaning associated with it in this section.

The indefinite articles "a" and "an" refer to at least one of the associated noun, and are used interchangeably with the terms "at least one" and "one or more." For example, "a module" means at least one module, or one or more modules.

The conjunctions "or" and "and/or" are used interchangeably as non-exclusive disjunctions.

"Domain" is used to describe a segment of a protein or nucleic acid. Unless otherwise indicated, a domain is not required to have any specific functional property.

The term "exogenous trans-acting factor" refers to any peptide or nucleotide component of a genome editing system that both (a) interacts with an RNA-guided nuclease or gRNA by means of a modification, such as a peptide or nucleotide insertion or fusion, to the RNA-guided nuclease or gRNA, and (b) interacts with a target DNA to alter a helical structure thereof. Peptide or nucleotide insertions or fusions may include, without limitation, direct covalent linkages between the RNA-guided nuclease or gRNA and the exogenous trans-acting factor, and/or non-covalent linkages mediated by the insertion or fusion of RNA/protein interaction domains such as MS2 loops and protein/protein interaction domains such as a PDZ, Lim or SH1, 2 or 3 domains. Other specific RNA and amino acid interaction motifs will be familiar to those of skill in the art. Trans-acting factors may include, generally, transcriptional activators.

The term "booster element" refers to an element which, when co-delivered with a ribonucleoprotein (RNP) complex comprising a gRNA complexed to RNA-guided nuclease ("gRNA-nuclease-RNP"), increases editing of a target nucleic acid compared with editing of the target nucleic acid without the booster element. In certain embodiments, co-delivery may be sequential or simultaneous. In certain embodiments, a booster element may be an RNP complex comprised of a dead guide RNA complexed with a WT Cas9 protein, a Cas9 nickase protein (e.g., Cas9 D10A protein), or an enzymatically inactive Cas9 (eiCas9) protein. In certain embodiments, a booster element may be an RNP complex comprised of a guide RNA complexed with a Cas9 nickase protein (e.g., Cas9 D10A protein) or an enzymatically inactive Cas9 (eiCas9) protein. In certain embodiments, a booster element may be a single- or double stranded donor template DNA. In certain embodiments, one or more booster elements may be codelivered with a gRNA-nuclease-RNP to increase editing of a target nucleic acid. In certain embodiments, a booster element may be co-delivered with an RNP comprising a gRNA complexed to a Cpf1 molecule ("gRNA-Cpf1-RNP") to increase editing of a target nucleic acid.

"Productive indel" refers to an indel (deletion and/or insertion) that results in HbF expression. In certain embodiments, a productive indel may induce HbF expression. In certain embodiments, a productive indel may result in an increased level of HbF expression.

An "indel" is an insertion and/or deletion in a nucleic acid sequence. An indel may be the product of the repair of a DNA double strand break, such as a double strand break formed by a genome editing system of the present disclosure. An indel is most commonly formed when a break is repaired by an "error prone" repair pathway such as the NHEJ pathway described below.

"Gene conversion" refers to the alteration of a DNA sequence by incorporation of an endogenous homologous sequence (e.g. a homologous sequence within a gene array). "Gene correction" refers to the alteration of a DNA sequence by incorporation of an exogenous homologous sequence, such as an exogenous single- or double stranded donor template DNA. Gene conversion and gene correction are products of the repair of DNA double-strand breaks by HDR pathways such as those described below.

Indels, gene conversion, gene correction, and other genome editing outcomes are typically assessed by sequencing (most commonly by "next-gen" or "sequencing-by-synthesis" methods, though Sanger sequencing may still be used) and are quantified by the relative frequency of numerical changes (e.g., ±1, ±2 or more bases) at a site of interest among all sequencing reads. DNA samples for sequencing may be prepared by a variety of methods known in the art, and may involve the amplification of sites of interest by polymerase chain reaction (PCR), the capture of DNA ends generated by double strand breaks, as in the GUIDEseq process described in Tsai 2016 (incorporated by reference herein) or by other means well known in the art. Genome editing outcomes may also be assessed by in situ hybridization methods such as the FiberComb™ system commercialized by Genomic Vision (Bagneux, France), and by any other suitable methods known in the art.

"Alt-HDR," "alternative homology-directed repair," or "alternative HDR" are used interchangeably to refer to the process of repairing DNA damage using a homologous nucleic acid (e.g., an endogenous homologous sequence, e.g., a sister chromatid, or an exogenous nucleic acid, e.g., a template nucleic acid). Alt-HDR is distinct from canonical HDR in that the process utilizes different pathways from canonical HDR, and can be inhibited by the canonical HDR mediators, RAD51 and BRCA2. Alt-HDR is also distinguished by the involvement of a single-stranded or nicked homologous nucleic acid template, whereas canonical HDR generally involves a double-stranded homologous template.

"Canonical HDR," "canonical homology-directed repair" or "cHDR" refer to the process of repairing DNA damage using a homologous nucleic acid (e.g., an endogenous homologous sequence, e.g., a sister chromatid, or an exogenous nucleic acid, e.g., a template nucleic acid). Canonical HDR typically acts when there has been significant resection at the double strand break, forming at least one single stranded portion of DNA. In a normal cell, cHDR typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

Unless indicated otherwise, the term "HDR" as used herein encompasses both canonical HDR and alt-HDR.

"Non-homologous end joining" or "NHEJ" refers to ligation mediated repair and/or non-template mediated repair including canonical NHEJ (cNHEJ) and alternative NHEJ (altNHEJ), which in turn includes microhomology-mediated end joining (MMEJ), single-strand annealing (SSA), and synthesis-dependent microhomology-mediated end joining (SD-MMEJ).

"Replacement" or "replaced," when used with reference to a modification of a molecule (e.g. a nucleic acid or protein), does not require a process limitation but merely indicates that the replacement entity is present.

"Subject" means a human, mouse, or non-human primate. A human subject can be any age (e.g., an infant, child, young adult, or adult), and may suffer from a disease, or may be in need of alteration of a gene.

"Treat," "treating," and "treatment" mean the treatment of a disease in a subject (e.g., a human subject), including one or more of inhibiting the disease, i.e., arresting or preventing its development or progression; relieving the disease, i.e., causing regression of the disease state; relieving one or more symptoms of the disease; and curing the disease.

"Prevent," "preventing," and "prevention" refer to the prevention of a disease in a subject, including (a) avoiding or precluding the disease; (b) affecting the predisposition toward the disease; or (c) preventing or delaying the onset of at least one symptom of the disease.

A "kit" refers to any collection of two or more components that together constitute a functional unit that can be employed for a specific purpose. By way of illustration (and not limitation), one kit according to this disclosure can include a guide RNA complexed or able to complex with an RNA-guided nuclease, and accompanied by (e.g. suspended in, or suspendable in) a pharmaceutically acceptable carrier. In certain embodiments, the kit may include a booster element. The kit can be used to introduce the complex into, for example, a cell or a subject, for the purpose of causing a desired genomic alteration in such cell or subject. The components of a kit can be packaged together, or they may be separately packaged. Kits according to this disclosure also optionally include directions for use (DFU) that describe the use of the kit e.g., according to a method of this disclosure. The DFU can be physically packaged with the kit, or it can be made available to a user of the kit, for instance by electronic means.

The terms "polynucleotide", "nucleotide sequence", "nucleic acid", "nucleic acid molecule", "nucleic acid sequence", and "oligonucleotide" refer to a series of nucleotide bases (also called "nucleotides") in DNA and RNA, and mean any chain of two or more nucleotides. The polynucleotides, nucleotide sequences, nucleic acids etc. can be chimeric mixtures or derivatives or modified versions thereof, single-stranded or double-stranded. They can be modified at the base moiety, sugar moiety, or phosphate backbone, for example, to improve stability of the molecule, its hybridization parameters, etc. A nucleotide sequence typically carries genetic information, including, but not limited to, the information used by cellular machinery to make proteins and enzymes. These terms include double- or single-stranded genomic DNA, RNA, any synthetic and genetically manipulated polynucleotide, and both sense and antisense polynucleotides. These terms also include nucleic acids containing modified bases.

Conventional IUPAC notation is used in nucleotide sequences presented herein, as shown in Table 1, below (see also Cornish-Bowden A, Nucleic Acids Res. 1985 May 10; 13(9):3021-30, incorporated by reference herein). It should be noted, however, that "T" denotes "Thymine or Uracil" in those instances where a sequence may be encoded by either DNA or RNA, for example in gRNA targeting domains.

TABLE 1

IUPAC nucleic acid notation

| Character | Base |
|---|---|
| A | Adenine |
| T | Thymine or Uracil |
| G | Guanine |
| C | Cytosine |
| U | Uracil |
| K | G or T/U |
| M | A or C |
| R | A or G |
| Y | C or T/U |
| S | C or G |
| W | A or T/U |
| B | C, G or T/U |
| V | A, C or G |
| H | A, C or T/U |
| D | A, G or T/U |
| N | A, C, G or T/U |

The terms "protein," "peptide" and "polypeptide" are used interchangeably to refer to a sequential chain of amino acids linked together via peptide bonds. The terms include individual proteins, groups or complexes of proteins that associate together, as well as fragments or portions, variants, derivatives and analogs of such proteins. Peptide sequences are presented herein using conventional notation, beginning with the amino or N-terminus on the left, and proceeding to the carboxyl or C-terminus on the right. Standard one-letter or three-letter abbreviations can be used.

The notation "CCAAT box target region" and the like refer to a sequence that is 5' of the transcription start site (TSS) of the HBG1 and/or HBG2 gene. CCAAT boxes are highly conserved motifs within the promoter region of α-like and β-like globin genes. The regions within or near the CCAAT box play important roles in globin gene regulation. For example, the γ-globin distal CCAAT box is associated with hereditary persistence of fetal hemoglobin. A number of transcription factors have been reported to bind to the duplicated CCAAT box region of the γ-globin promoter, e.g., NF-Y, COUP-TFII (NF-E3), CDP, GATA1/NF-E 1 and DRED (Martyn 2017). While not wishing to be bound by theory, it is believed that the binding sites of the transcriptional activator NF-Y overlaps with transcriptional repressors at the γ-globin promoter. HPFH mutations present within the distal γ-globin promoter region, e.g., within or near the CCAAT box, may alter the competitive binding of those factors and thus contribute to the increased γ-globin expression and elevated levels of HbF. Genomic locations provided herein for HBG1 and HBG2 are based on the coordinates provided in NCBI Reference Sequence NC_000011, "*Homo sapiens* chromosome 11, GRCh38.p12 Primary Assembly," (Version NC_000011.10). The distal CCAAT box of HBG1 and HBG2 is positioned at HBG1 and HBG2 c.-111 to -115 (Genomic location is Hg38 Chr11:5, 249,968 to Chr11:5,249,972 and Hg38 Chr11:5,254,892 to Chr11:5,254,896, respectively). The HBG1 c.-111 to -115 region is exemplified in SEQ ID NO:902(HBG1) at positions 2823-2827, and the HBG2 c.-III to -115 region is exemplified in SEQ ID NO:903 (HBG2) at positions 2747-2751. In certain embodiments, the "CCAAT box target region" denotes the region that is at or near the distal CCAAT box and includes the nucleotides of the distal CCAAT box and 25 nucleotides upstream (5') and 25 nucleotides downstream (3') of the distal CCAAT box (i.e., HBG1/2 c.-86 to -140) (Genomic location is Hg38 Chr11: 5249943 to Hg38 Chr11:5249997 and Hg38 Chr11:5254867 to Hg38 Chr11:5254921, respectively). The HBG1 c.-86 to -140 region is exemplified in SEQ ID NO:902 (HBG1) at positions 2798-2852, and the HBG2 c.-86 to -140 region is exemplified in SEQ ID NO:903 (HBG2) at positions 2723-2776. In other embodiments, the "CCAAT box target region" denotes the region that is at or near the distal CCAAT box and includes the nucleotides of the distal CCAAT box and 5 nucleotides upstream (5') and 5 nucleotides downstream (3') of the distal CCAAT box (i.e., HBG1/2 c.-106 to -120 (Genomic location is Hg38 Chr11: 5249963 to Hg38 Chr11:5249977 (HGB1 and Hg38 Chr11: 5254887 to Hg38 Chr11:5254901, respectively)). The HBG1 c.-106 to -120 region is exemplified in SEQ ID NO:902 (HBG1) at positions 2818-2832, and the HBG2 c.-106 to -120 region is exemplified in SEQ ID NO:903 (HBG2) at positions 2742-2756. The term "CCAAT box target site alteration" and the like refer to alterations (e.g., deletions, insertions, mutations) of one or more nucleotides of the CCAAT box target region. Examples of exemplary CCAAT box target region alterations include, without limitation, the 1 nt deletion, 4 nt deletion, 11nt deletion, 13 nt deletion, and 18 nt deletion, and −117 G>A alteration. As used herein, the terms "CCAAT box" and "CAAT box" can be used interchangeably.

The notations "c.-114 to -102 region," "c.-102 to -114 region," "−102:-114," "13 nt target region" and the like refer to a sequence that is 5' of the transcription start site (TSS) of the HBG1 and/or HBG2 gene at the genomic location Hg38 Chr11:5,249,959 to Hg38 Chr11:5,249,971 and Hg38 Chr 11:5,254,883 to Hg38 Chr 11:5,254,895, respectively. The HBG1 c.-102 to -114 region is exemplified in SEQ ID NO:902 (HBG1) at positions 2824-2836 and the HBG2 c.-102 to -114 region is exemplified in SEQ ID NO:903 (HBG2) at positions 2748-2760. The term "13 nt deletion" and the like refer to deletions of the 13 nt target region.

The notations "c.-121 to -104 region," "c.-104 to -121 region," "−104:-121," "18 nt target region," and the like refer to a sequence that is 5' of the transcription start site (TSS) of the HBG1 and/or HBG2 gene at the genomic location Hg38 Chr11:5,249,961 to Hg38 Chr11:5,249,978 and Hg38 Chr11:5,254,885 to Hg38 Chr11: 5,254,902, respectively. The HBG1c.-104 to -121 region is exemplified in SEQ ID NO:902 (HBG1) at positions 2817-2834, and the HBG2 c.-104 to -121 region is exemplified in SEQ ID NO:903 (HBG2) at positions 2741-2758. The term "18 nt deletion" and the like refer to deletions of the 18 nt target region.

The notations "c.-105 to -115 region," "c.-115 to -105 region," "−105:-115," "11 nt target region," and the like refer to a sequence that is 5' of the transcription start site (TSS) of the HBG1 and/or HBG2 gene at the genomic location Hg38 Chr11:5,249,962 to Hg38 Chr11:5,249,972 and Hg38 Chr11:5,254,886 to Hg38 Chr11:5,254,896, respectively. The HBG1 c.-105 to -115 region is exemplified in SEQ ID NO:902 (HBG1) at positions 2823-2833, and the HBG2 c.-105 to -115 region is exemplified in SEQ ID NO:903 (HBG2) at positions 2747-2757. The term "ii nt deletion" and the like refer to deletions of the 11 nt target region.

The notations "c.-115 to -112 region," "c.-112 to -115 region," "−112:-115," "4 nt target region," and the like refer to a sequence that is 5' of the transcription start site (TSS) of the HBG1 and/or HBG2 gene at the genomic location Hg38 Chr11:5,249,969 to Hg38 Chr11:5,249,972 and Hg38 Chr11:5,254,893 to Hg38 Chr11:5,254,896, respectively. The HBG1 c.-112 to -115 region is exemplified in SEQ ID NO:902 at positions 2823-2826, and the HBG2 c.-112 to -115 region is exemplified in SEQ ID NO:903 (HBG2) at positions 2747-2750. The term "4 nt deletion" and the like refer to deletions of the 4 nt target region.

The notations "c.-116 region," "HBG-116," "1 nt target region," and the like refer to a sequence that is 5' of the transcription start site (TSS) of the HBG1 and/or HBG2 gene at the genomic location Hg38 Chr11:5,249,973 and Hg38 Chr11:5,254,897, respectively. The HBG1 c.-116 region is exemplified in SEQ ID NO:902 at position 2822, and the HBG2 c.-116 region is exemplified in SEQ ID NO:903 (HBG2) at position 2746. The term "1 nt deletion" and the like refer to deletions of the 1 nt target region.

The notations "c.-117 G>A region," "HBG-117 G>A," "−117 G>A target region" and the like refer to a sequence that is 5' of the transcription start site (TSS) of the HBG1 and/or HBG2 gene at the genomic location Hg38 Chr11:5, 249,974 to Hg38 Chr11:5,249,974 and Hg38 Chr11:5,254, 898 to Hg38 Chr11:5,254,898, respectively. The HBG1 c.-117 G>A region is exemplified by a substitution from guanine (G) to adenine (A) in SEQ ID NO:902 at position 2821, and the HBG2 c.-117 G>A region is exemplified by a substitution from G to A in SEQ ID NO:903 (HBG2) at position 2745. The term "−117 G>A alteration" and the like refer to a substitution from G to A at the −117G>A target region.

The term "proximal HBG1/2 promoter target sequence" denotes the region within 50, 100, 200, 300, 400, or 500 bp of a proximal HBG1/2 promoter sequence including the 13 nt target region. Alterations by genome editing systems according to this disclosure facilitate (e.g. cause, promote or tend to increase the likelihood of) upregulation of HbF production in erythroid progeny.

The term "GATA1 binding motif in BCL11Ae" refers to the sequence that is the GATA1 binding motif in the erythroid specific enhancer of BCL11A (BCL11Ae) that is in the +58 DNase I hypersensitive site (DHS) region of intron 2 of the BCL11A gene. The genomic coordinates for the GATA1 binding motif in BCL11Ae are chr2: 60,495,265 to 60,495, 270. The +58 DHS site comprises a 115 base pair (bp) sequence as set forth in SEQ ID NO:968. The +58 DHS site sequence, including ~500 bp upstream and ~200 bp downstream is set forth in SEQ ID NO: 969.

Where ranges are provided herein, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

Overview

The various embodiments of this disclosure generally relate to genome editing systems configured to introduce alterations (e.g., a deletion or insertion, or other mutation) into chromosomal DNA that enhance transcription of the HBG1 and/or HBG2 genes, which encode the Aγ and Gγ subunits of hemoglobin, respectively. In certain embodiments, increased expression of one or more γ-globin genes (e.g., HBG1, HBG2) using the methods provided herein results in preferential formation of HbF over HbA and/or increased HbF levels as a percentage of total hemoglobin. In certain embodiments, the disclosure generally relates to the use of RNP complexes comprising a gRNA complexed to a Cpf1 molecule. In certain embodiments, the gRNA may be unmodified or modified, the Cpf1 molecule may be a wild-type Cpf1 protein or a modified Cpf1 protein. In certain embodiments, the gRNA may comprise a sequence set forth in Table 13, Table 18, or Table 19. In certain embodiments, a modified Cpf1 may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO:1097 (RNP32, Table 21).

It has previously been shown that patients with the condition Hereditary Persistence of Fetal Hemoglobin (HPFH) contain mutations in an γ-globin regulatory element that results in fetal γ-globin expression throughout life, rather than being repressed around the time of birth (Martyn 2017). This results in elevated fetal hemoglobin (HbF) expression. HPFH mutations may be deletional or non-deletional (e.g., point mutations). Subjects with HPFH exhibit lifelong expression of HbF, i.e., they do not undergo or undergo only partial globin switching, with no symptoms of anemia.

HbF expression can be induced through point mutations in an γ-globin regulatory element that is associated with a naturally occurring HPFH variant, including, for example, HBG1 c.-114 C>T; c.-117 G>A; c.-158 C>T; c.-167 C>T; c.-170 G>A; c.-175 T>G; c.-175 T>C; c.-195 C>G; c.-196 C>T; c.-197 C>T; c.-198 T>C; c.-201 C>T; c.-202 C>T; c.-211 C>T, c.-251 T>C; or c.-499 T>A; or HBG2 c.-109 G>T; c.-110 A>C; c.-114 C>A; c.-114 C>T; c.-114 C>G; c.-157 C>T; c.-158 C>T; c.-167 C>T; c.-167 C>A; c.-175 T>C; c.-197 C>T; c.-200+C; c.-202 C>G; c.-211 C>T; c.-228 T>C; c.-255 C>G; c.-309 A>G; c.-369 C>G; or c.-567 T>G.

Naturally occurring mutations at the distal CCAAT box motif found within the promoter of the HBG1 and/or HBG2 genes (i.e., HBG1/2 c.-111 to -115) have also been shown to result in continued γ-globin expression and the HPFH condition. It is thought that alteration (mutation or deletion) of the CCAAT box may disrupt the binding of one or more transcriptional repressors, resulting in continued expression of the γ-globin gene and elevated HbF expression (Martyn 2017). For example, a naturally occurring 13 base pair del c.-114 to -102 ("13 nt deletion") has been shown to be associated with elevated levels of HbF (Martyn 2017). The distal CCAAT box likely overlaps with the binding motifs within and surrounding the CCAAT box of negative regulatory transcription factors that are expressed in adulthood and repress HBG (Martyn 2017).

A gene editing strategy disclosed herein is to increase HbF expression by disrupting one or more nucleotides in the distal CCAAT box and/or surrounding the distal CCAAT box. In certain embodiments, the "CCAAT box target region" may be the region that is at or near the distal CCAAT box and includes the nucleotides of the distal CCAAT box and 25 nucleotides upstream (5') and 25 nucleotides downstream (3') of the distal CCAAT box (i.e., HBG1/2 c.-86 to -140). In other embodiments, the "CCAAT box target region" may be the region that is at or near the distal CCAAT box and includes the nucleotides of the distal CCAAT box and 5 nucleotides upstream (5') and 5 nucleotides downstream (3') of the distal CCAAT box (i.e., HBG1/2 c.-106 to -120). Unique, non-naturally occurring alterations of the CCAAT box target region are disclosed herein that induce HBG expression including, without limitation, HBG del c.-104 to -121 ("18 nt deletion"), HBG del c.-105 to -115 ("11 nt deletion"), HBG del c.-112 to -115 ("4 nt deletion"), and HBG del c.-116 ("1 nt deletion"). In certain embodiments, genome editing systems disclosed herein may be used to introduce alterations into the CCAAT box target region of HBG1 and/or HBG2. In certain embodiments, the genome editing systems may include one or more of a DNA donor template that encodes an alteration (such as a deletion, insertion, or mutation) in the CCAAT box target region. In certain embodiments, the alterations may be non-naturally occurring alterations or naturally occurring alterations. In certain embodiments, the donor templates may encode the 1 nt deletion, 4 nt deletion, 11 nt deletion, 13 nt deletion, 18 nt deletion, or c.-117 G>A alteration. In certain embodiments, the genome editing systems may include an RNA guided nuclease including a Cas9, modified Cas 9, a Cpf1, or modified Cpf1. In certain embodiments, the genome editing systems may include an RNP comprising a gRNA and a Cpf1 molecule. In certain embodiments, a gRNA may be unmodified or modified, the Cpf1 molecule may be a wild-type Cpf1 protein or a modified Cpf1 protein, or a combination thereof. In certain embodiments, the gRNA may comprise a sequence set forth in Table 13, Table 18, or Table 19. In certain embodiments, a modified Cpf1 may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO: 1097 (RNP32, Table 21).

HbF expression can also be induced through targeted disruption of the erythroid cell specific expression of a transcriptional repressor, BCL11A, which encodes a repressor that silences HBG1 and HBG2 (Canvers 2015). Another gene editing strategy disclosed herein is to increase HbF expression by targeting disruption the of the erythroid specific enhancer of BCL11A (BCL11Ae) (also discussed in commonly-assigned International Patent Publication No. WO 2015/148860 by Friedland et al. ("Friedland"), published Oct. 1, 2015, which is incorporated by reference in its entirety herein). In certain embodiments, the region of BCL11Ae targeted for disruption may be the GATA1 binding motif in BCL11Ae. In certain embodiments, genome editing systems disclosed herein may be used to introduce alterations into the GATA1 binding motif in BCL11Ae, the CCAAT box target region, the 13 nt target region of HBG1 and/or HBG2, or a combination thereof.

The genome editing systems of this disclosure can include an RNA-guided nuclease such as Cas9 or Cpf1 and one or more gRNAs having a targeting domain that is complementary to a sequence in or near the target region, and optionally one or more of a DNA donor template that encodes a specific mutation (such as a deletion or insertion) in or near the target region, and/or an agent that enhances the efficiency with which such mutations are generated including, without limitation, a random oligonucleotide, a small molecule agonist or antagonist of a gene product involved in DNA repair or a DNA damage response, or a peptide agent.

A variety of approaches to the introduction of mutations into the CCAAT box target region, 13 nt target region, proximal HBG1/2 promoter target sequence, and/or the GATA1 binding motif in BCL11Ae may be employed in the embodiments of the present disclosure. In one approach, a single alteration, such as a double-strand break, is made within the CCAAT box target region, 13 nt target region, proximal HBG1/2 promoter target sequence, and/or the GATA1 binding motif in BCL11Ae, and is repaired in a way that disrupts the function of the region, for example by the formation of an indel or by the incorporation of a donor template sequence that encodes the deletion of the region. In a second approach, two or more alterations are made on either side of the region, resulting in the deletion of the intervening sequence, including the CCAAT box target region, 13 nt target region and/or the GATA1 binding motif in BCL11Ae.

The treatment of hemoglobinopathies by gene therapy and/or genome editing is complicated by the fact that the cells that are phenotypically affected by the disease, erythrocytes or RBCs, are enucleated, and do not contain genetic material encoding either the aberrant hemoglobin protein (Hb) subunits nor the Aγ or Gγ subunits targeted in the exemplary genome editing approaches described above. This complication is addressed, in certain embodiments of this disclosure, by the alteration of cells that are competent to differentiate into, or otherwise give rise to, erythrocytes. Cells within the erythroid lineage that are altered according to various embodiments of this disclosure include, without limitation, hematopoietic stem and progenitor cells (HSCs), erythroblasts (including basophilic, polychromatic and/or orthochromatic erythroblasts), proerythroblasts, polychromatic erythrocytes or reticulocytes, embryonic stem (ES) cells, and/or induced pluripotent stem (iPSC) cells. These cells may be altered in situ (e.g. within a tissue of a subject) or ex vivo. Implementations of genome editing systems for in situ and ex vivo alteration of cells is described under the heading "Implementation of genome editing systems: delivery, formulations, and routes of administration" below.

In certain embodiments, alterations that result in induction of Aγ and/or Gγ expression are obtained through the use of a genome editing system comprising an RNA-guided nuclease and at least one gRNA having a targeting domain complementary to a sequence within the CCAAT box target region of HBG1 and/or HBG2 or proximate thereto (e.g., within 10, 20, 30, 40, or 50, 100, 200, 300,400 or 500 bases of the CCAAT box target region). As is discussed in greater detail below, the RNA-guided nuclease and gRNA form a complex that is capable of associating with and altering the CCAAT box target region or a region proximate thereto. Examples of suitable gRNAs and gRNA targeting domains directed to the CCAAT box target region of HBG1 and/or HBG2 or proximate thereto for use in the embodiments disclosed herein include, without limitation, those set forth in SEQ ID NOs:251-901, 940-942, 970, 971, 996, 997, 1002, and 1004.

In certain embodiments, alterations that result in induction of Aγ and/or Gγ expression are obtained through the use of a genome editing system comprising an RNA-guided nuclease and at least one gRNA having a targeting domain complementary to a sequence within the 13 nt target region of HBG1 and/or HBG2 or proximate thereto (e.g., within 10, 20, 30, 40, or 50, 100, 200, 300, 400 or 500 bases of the 13 nt target region). As is discussed in greater detail below, the RNA-guided nuclease and gRNA form a complex that is capable of associating with and altering the 13 nt target region or a region proximate thereto. Examples of suitable gRNAs and gRNA targeting domains directed to the 13 nt target region of HBG1 and/or HBG2 or proximate thereto for use in the embodiments disclosed herein include, without limitation, those set forth in SEQ ID NOs:251-901, 940-942, 970, 971, 996, 997, 1002, and 1004.

In certain embodiments, alterations that result in induction of HbF expression are obtained through the use of a genome editing system comprising an RNA-guided nuclease and at least one gRNA having a targeting domain complementary to a sequence within the GATA1 binding motif in BCL11Ae or proximate thereto (e.g., within 10, 20, 30, 40, or 50, 100, 200, 300, 400 or 500 bases of the GATA1 binding motif in BCL11Ae). In certain embodiments, the RNA-guided nuclease and gRNA form a complex that is capable of associating with and altering the GATA1 binding motif in BCL11Ae. Examples of suitable targeting domains directed to the GATA1 binding motif in BCL11Ae for use in the embodiments disclosed herein include, without limitation, those set forth in SEQ ID NOs:952-955.

The genome editing system can be implemented in a variety of ways, as is discussed below in detail. As an example, a genome editing system of this disclosure can be implemented as a ribonucleoprotein complex or a plurality of complexes in which multiple gRNAs are used. This ribonucleoprotein complex can be introduced into a target cell using art-known methods, including electroporation, as described in commonly-assigned International Patent Publication No. WO 2016/182959 by Jennifer Gori ("Gori"), published Nov. 17, 2016, which is incorporated by reference in its entirety herein.

The ribonucleoprotein complexes within these compositions are introduced into target cells by art-known methods, including without limitation electroporation (e.g. using the Nucleofection™ technology commercialized by Lonza, Basel, Switzerland or similar technologies commercialized by, for example, Maxcyte Inc. Gaithersburg, Maryland) and lipofection (e.g. using Lipofectamine™ reagent commercialized by Thermo Fisher Scientific, Waltham Massachusetts). Alternatively, or additionally, ribonucleoprotein complexes are formed within the target cells themselves following introduction of nucleic acids encoding the RNA-guided nuclease and/or gRNA. These and other delivery modalities are described in general terms below and in Gori.

Cells that have been altered ex vivo according to this disclosure can be manipulated (e.g. expanded, passaged, frozen, differentiated, de-differentiated, transduced with a transgene, etc.) prior to their delivery to a subject. The cells are, variously, delivered to a subject from which they are obtained (in an "autologous" transplant), or to a recipient who is immunologically distinct from a donor of the cells (in an "allogeneic" transplant).

In some cases, an autologous transplant includes the steps of obtaining, from the subject, a plurality of cells, either circulating in peripheral blood, or within the marrow or other tissue (e.g. spleen, skin, etc.), and manipulating those cells to enrich for cells in the erythroid lineage (e.g. by induction to generate iPSCs, purification of cells expressing certain cell surface markers such as CD34, CD90, CD49f and/or not expressing surface markers characteristic of non-erythroid lineages such as CD10, CD14, CD38, etc.). The cells are, optionally or additionally, expanded, transduced with a transgene, exposed to a cytokine or other peptide or small molecule agent, and/or frozen/thawed prior to transduction with a genome editing system targeting the CCAAT box target region, the 13 nt target region, proximal HBG1/2 promoter target sequence, and/or the GATA1 binding motif in BCL11Ae. The genome editing system can be implemented or delivered to the cells in any suitable format, including as a ribonucleoprotein complex, as separated protein and nucleic acid components, and/or as nucleic acids encoding the components of the genome editing system.

In certain embodiments, CD34+ hematopoietic stem and progenitor cells (HSPCs) that have been edited using the genome editing methods disclosed herein may be used for the treatment of a hemoglobinopathy in a subject in need thereof. In certain embodiments, the hemoglobinopathy may be severe sickle cell disease (SCD) or thalassemia, such as β-thalassemia, δ-thalassemia, or β/δ-thalassemia. In certain embodiments, an exemplary protocol for treatment of a hemoglobinopathy may include harvesting CD34+ HSPCs from a subject in need thereof, ex vivo editing of the autologous CD34+ HSPCs using the genome editing methods disclosed herein, followed by reinfusion of the edited autologous CD34+ HSPCs into the subject. In certain embodiments, treatment with edited autologous CD34+ HSPCs may result in increased HbF induction.

Prior to harvesting CD34+ HSPCs, in certain embodiments, a subject may discontinue treatment with hydroxyurea, if applicable, and receive blood transfusions to maintain sufficient hemoglobin (Hb) levels. In certain embodiments, a subject may be administered intravenous plerixafor (e.g., 0.24 mg/kg) to mobilize CD34+ HSPCs from bone marrow into peripheral blood. In certain embodiments, a subject may undergo one or more leukapheresis cycles (e.g., approximately one month between cycles, with one cycle defined as two plerixafor-mobilized leukapheresis collections performed on consecutive days). In certain embodiments, the number of leukapheresis cycles performed for a subject may be the number required to achieve a dose of edited autologous CD34+ HSPCs (e.g., $\geq 2\times 10^6$ cells/kg, $\geq 3\times 10^6$ cells/kg, $\geq 4\times 10^6$ cells/kg, $\geq 5\times 10^6$ cells/kg, $2\times 10^6$ cells/kg to $3\times 10^6$ cells/kg, $3\times 10^6$ cells/kg to $4\times 10^6$ cells/kg, $4\times 10^6$ cells/kg to $5\times 10^6$ cells/kg) to be reinfused back into the subject, along with a dose of unedited autologous CD34+ HSPCs/kg for backup storage (e.g., $>1.5\times 10^6$ cells/kg). In certain embodiments, the CD34+ HSPCs harvested from the subject may be edited using any of the genome editing methods discussed herein. In certain embodiments, any one or more of the gRNAs and one or more of the RNA-guided nucleases disclosed herein may be used in the genome editing methods.

In certain embodiments, the treatment may include an autologous stem cell transplant. In certain embodiments, a subject may undergo myeloablative conditioning with busulfan conditioning (e.g., dose-adjusted based on first-dose pharmacokinetic analysis, with a test dose of 1 mg/kg). In certain embodiments, conditioning may occur for four consecutive days. In certain embodiments, following a three-day busulfan washout period, edited autologous CD34+ HSPCs (e.g., $\geq 2\times 10^6$ cells/kg, $\geq 3\times 10^6$ cells/kg, $\geq 4\times 10^6$ cells/kg, $\geq 5\times 10^6$ cells/kg, $2\times 10^6$ cells/kg to $3\times 10^6$ cells/kg, $3\times 10^6$ cells/kg to $4\times 10^6$ cells/kg, $4\times 10^6$ cells/kg to $5\times 10^6$ cells/kg) may be reinfused into the subject (e.g., into peripheral blood). In certain embodiments, the edited autologous CD34+ HSPCs may be manufactured and cryopreserved for a particular subject. In certain embodiments, a subject may attain neutrophil engraftment following a sequential myeloablative conditioning regimen and infusion of edited autologous CD34+ cells. Neutrophil engraftment may be defined as three consecutive measurements of ANC$\geq 0.5\times 10^9$/L.

However it is implemented, a genome editing system may include, or may be co-delivered with, one or more factors that improve the viability of the cells during and after editing, including without limitation an aryl hydrocarbon receptor antagonist such as StemRegenin-1 (SR1), UM171, LGC0006, alpha-napthoflavone, and CH-223191, and/or an innate immune response antagonist such as cyclosporin A, dexamethasone, reservatrol, a MyD88 inhibitory peptide, an RNAi agent targeting Myd88, a B18R recombinant protein, a glucocorticoid, OxPAPC, a TLR antagonist, rapamycin, BX795, and a RLR shRNA. These and other factors that improve the viability of the cells during and after editing are described in Gori, under the heading "I. Optimization of Stem Cells" from page 36 through page 61, which is incorporated by reference herein.

The cells, following delivery of the genome editing system, are optionally manipulated e.g. to enrich for HSCs and/or cells in the erythroid lineage and/or for edited cells, to expand them, freeze/thaw, or otherwise prepare the cells for return to the subject. The edited cells are then returned to the subject, for instance in the circulatory system by means of intravenous delivery or delivery or into a solid tissue such as bone marrow.

Functionally, alteration of the CCAAT box target region, 13 nt target region, proximal HBG1/2 promoter target sequence, and/or the GATA1 binding motif in BCL11Ae using the compositions, methods and genome editing systems of this disclosure results in significant induction, among hemoglobin-expressing cells, of Aγ and/or Gγ subunits (referred to interchangeably as HbF expression), e.g. at least 5%, 10%, 15%, 20%, 25%, 30%, 35%, 40%, 45%, 50% or greater induction of Aγ and/or Gγ subunit expression relative to unmodified controls. This induction of protein expression is generally the result of alteration of the CCAAT box target region, 13 nt target region, proximal HBG1/2 promoter target sequence, and/or the GATA1 binding motif in BCL11Ae (expressed, e.g. in terms of the percentage of total genomes comprising indel mutations within the plurality of cells) in some or all of the plurality of cells that are treated, e.g. at least 5%, 10%, 15%, 20%, 25%, 30%, 35%, 40%, 45%, 50% of the plurality of cells comprise at least one allele comprising a sequence alteration, including, without limitation, an indel, insertion, or deletion in or near the CCAAT box target region, 13 nt target region, proximal HBG1/2 promoter target sequence, and/or the GATA1 binding motif in BCL11Ae.

The functional effects of alterations caused or facilitated by the genome editing systems and methods of the present disclosure can be assessed in any number of suitable ways. For example, the effects of alterations on expression of fetal hemoglobin can be assessed at the protein or mRNA level. Expression of HBG1 and HBG2 mRNA can be assessed by digital droplet PCR (ddPCR), which is performed on cDNA samples obtained by reverse transcription of mRNA harvested from treated or untreated samples. Primers for HBG1, HBG2, HBB, and/or HBA may be used individually or multiplexed using methods known in the art. For example, ddPCR analysis of samples may be conducted using the QX200™ ddPCR system commercialized by Bio Rad (Hercules, CA), and associated protocols published by BioRad. Fetal hemoglobin protein may be assessed by high pressure liquid chromatography (HPLC), for example, according to the methods discussed on pp. 143-44 in Chang 2017 (incorporated by reference herein), or fast protein liquid chromatography (FPLC), using ion-exchange and/or reverse phase columns to resolve HbF, HbB and HbA and/or Aγ and Gγ globin chains as is known in the art.

It should be noted that the rate at which the CCAAT box target region (e.g., 18 nt, 11 nt, 4 nt, 1 nt, c.-117 G>A target regions), 13 nt target region, proximal HBG1/2 promoter target sequence, and/or the GATA1 binding motif in BCL11Ae is altered in the target cells can be modified by the use of optional genome editing system components such as oligonucleotide donor templates. Donor template design is described in general terms below under the heading "Donor template design." Donor templates for use in targeting the 13 nt target region may include, without limitation, donor templates encoding alterations (e.g., deletions) of HBG1 c.-114 to -102 (corresponding to nucleotides 2824-2836 of SEQ ID NO: 902), HBG1 c.-225 to -222 (corresponding to nucleotides 2716-2719 of SEQ ID NO:902)), and/or HBG2 c.-114 to -102 (corresponding to nucleotides 2748-2760 of SEQ ID NO:903). Exemplary 5' and 3' homology arms, and exemplary full-length donor templates encoding deletions such as c.-114 to -102 are also presented below (SEQ ID NOS: 904-909). In certain embodiments, donor templates for use in targeting the 18 nt target region may include, without limitation, donor templates encoding alterations (e.g., deletions) of HBG1 c.-104 to -121, HBG2 c.-104 to -121, or a combination thereof. Exemplary full-length donor templates encoding deletions such as c.-104 to -121 include SEQ ID NOs:974 and 975. In certain embodiments, donor templates for use in targeting the 11 nt target region may include, without limitation, donor templates encoding alterations (e.g., deletions) of HBG1 c.-105 to -115, HBG2 c.-105 to -115, or a combination thereof. Exemplary full-length donor templates encoding deletions such as c.-105 to -115 include SEQ ID NOs:976 and 978. In certain embodiments, donor templates for use in targeting the 4 nt target region may include, without limitation, donor templates encoding alterations (e.g., deletions) of HBG1 c.-112 to -115, HBG2 c.-112 to -115, or a combination thereof. Exemplary full-length donor templates encoding deletions such as c.-112 to -115 include SEQ ID NOs:984-995. In certain embodiments, donor templates for use in targeting the 1 nt target region may include, without limitation, donor templates encoding alterations (e.g., deletions) of HBG1 c.-116, HBG2 c.-116, or a combination thereof. Exemplary full-length donor templates encoding deletions such as c.-116 include SEQ ID NOs:982 and 983. In certain embodiments, donor templates for use in targeting the c.-117 G>A target region may include, without limitation, donor templates encoding alterations (e.g., deletions) of HBG1 c.-117 G>A, HBG2 c.-117 G>A, or a combination thereof. Exemplary full-length donor templates encoding deletions such as c.-117 G>A include SEQ ID NOs:980 and 981. In certain embodiments, the donor template may be a positive strand or a negative strand.

Donor templates used herein may be non-specific templates that are non-homologous to regions of DNA within or near the target sequence. In certain embodiments, donor templates for use in targeting the 13 nt target region may include, without limitation, non-target specific templates that are nonhomologous to regions of DNA within or near the 13 nt target region. For example, a non-specific donor template for use in targeting the 13 nt target region may be non-homologous to the regions of DNA within or near the 13 nt target region and may comprise a donor template encoding the deletion of HBG1 c.-225 to -222 (corresponding to nucleotides 2716-2719 of SEQ ID NO:902). In certain embodiments, donor templates for use in targeting the GATA1 binding motif in BCL11Ae may include, without limitation, non-target specific templates that are nonhomologous to regions of DNA within or near GATA1 binding motif in BCL11Ae target sequence. Other donor templates for use in targeting BCL11Ae may include, without limitation, donor templates including alterations (e.g., deletions) of BCL11Ae, including, without limitation, the GATA1 motif in BCL11Ae.

The embodiments described herein may be used in all classes of vertebrate including, but not limited to, primates, mice, rats, rabbits, pigs, dogs, and cats.

This overview has focused on a handful of exemplary embodiments that illustrate the principles of genome editing systems and CRISPR-mediated methods of altering cells. For clarity, however, this disclosure encompasses modifications and variations that have not been expressly addressed above, but will be evident to those of skill in the art. With that in mind, the following disclosure is intended to illustrate the operating principles of genome editing systems more generally. What follows should not be understood as limiting, but rather illustrative of certain principles of genome editing systems and CRISPR-mediated methods utilizing these systems, which, in combination with the instant disclosure, will inform those of skill in the art about additional implementations and modifications that are within its scope.

RNA-Guided Helicases, Guide RNAs and Dead Guide RNAs

Various embodiments of the present disclosure also generally relate to genome editing systems configured to alter the helical structure of a nucleic acid to enhance genome editing of a target region (e.g., the CCAAT box target region, 13 nt target region, proximal HBG1/2 promoter target sequence, and/or the GATA1 binding motif in BCL11Ae) in the nucleic acid, and methods and compositions thereof. Many embodiments relate to the observation that positioning an event that alters the helical structure of DNA within or adjacent to target regions in nucleic acid may improve the activity of genome editing systems directed to such target regions. Without wishing to be bound by any theory, it is thought that alterations of helical structure (e.g., by unwinding) within or proximal to DNA target regions may induce or increase accessibility of a genome editing system to the target region, resulting in increased editing of the target regions by the genome editing system.

CRISPR nucleases evolved primarily to defend bacteria against viral pathogens, whose genomes are not naturally organized into chromatin. By contrast, when eukaryotic genomes are organized into nucleosomal units comprising genomic DNA segments coiled around histones. CRISPR nucleases from several bacterial families have been found to be inactive for editing eukaryotic DNA, suggesting the ability to edit nucleosome-bound DNA might differ across enzymes (Ran 2015). Biochemical evidence shows that *S. pyogenes* Cas9 can cleave DNA efficiently at nucleosome edges, but has reduced activity when the target site is positioned near the center of nucleosome dyad (Hinz 2016).

In many cell types, target sites of interest may be strongly bound by nucleosomes, or may only possess adjacent PAMs for enzymes that do not edit efficiently in the presence of nucleosomes. In this case, the problematic nucleosomes could be displaced first by using adjacent target sites that are closer to the nucleosome edge or are bound by an enzyme that is more effective at binding nucleosomal DNA. However, cleavage at these adjacent sites could be detrimental to the therapeutic strategy. Therefore, having a programmable enzyme that binds these adjacent sites but does not cleave can enable more efficient functional editing.

A related strategy utilizes recruitment of exogenous trans-acting factors to facilitate nucleosome displacement. However, the systems and methods of this disclosure are advantageous over this strategy because they do not require gRNA modifications beyond truncation of the targeting domain, do not require the recruitment of exogenous trans-acting factors, and do not require transcriptional activation to achieve increased rates of editing.

A variety of approaches to the unwinding and alteration of nucleic acid are employed in the various embodiments of this disclosure. One approach comprises unwinding (or opening of) a chromatin segment within or proximal to a target region (e.g., the CCAAT box target region, 13 nt target region, proximal HBG1/2 promoter target sequence, and/or the GATA1 binding motif in BCL11Ae) of a nucleic acid in a cell and generating a double stranded break (DSB) within the target region of the nucleic acid whereby the target region is altered. In certain embodiments, the DSB may be repaired in a manner that alters the target region. Unwinding the chromatin segment using the methods provided herein may facilitate increased access of catalytically active RNPs (e.g., catalytically active RNA-guided nucleases and gRNAs) to the chromatin to allow for more efficient editing of the DNA. For example, these methods may be used to edit target regions in chromatin that are difficult for a ribonucleoprotein (e.g., RNA-guided nuclease complexed to gRNA) to access because the chromatin is occupied by nucleosomes, such as closed chromatin. In certain embodiments, the unwinding of the chromatin segment occurs via RNA-guided helicase activity. In certain embodiments, the unwinding step does not require recruiting an exogenous trans-acting factor to the chromatin segment. In certain embodiments, the step of unwinding the chromatin segment does not comprise forming a single or double-stranded break in the nucleic acid within the chromatin segment.

In certain embodiments of the approaches and methods described above, the alteration of DNA helical structure is achieved through the action of an "RNA-guided helicase," which term is generally used to refer to a molecule, typically a peptide, that (a) interacts (e.g., complexes) with a gRNA, and (b) together with the gRNA, associates with and unwinds a target site. RNA-guided helicases may, in certain embodiments, comprise RNA-guided nucleases configured to lack nuclease activity. However, the inventors have observed that even a cleavage-competent RNA-guided nuclease may be adapted for use as an RNA-guided helicase by complexing it to a dead gRNA having a truncated targeting domain of 15 or fewer nucleotides in length. Complexes of wild-type RNA-guided nucleases with dead gRNAs exhibit reduced or eliminated RNA-cleavage activity, but appear to retain helicase activity. RNA-guided helicases and dead gRNAs are described in greater detail below.

Regarding RNA-guided helicases, according to the present disclosure an RNA-guided helicase may comprise any of the RNA-guided nucleases disclosed herein and infra under the heading entitled "RNA-guided nucleases," including, without limitation, a Cas9 or Cpf1 RNA-guided nuclease. The helicase activity of these RNA-guided nucleases allow for unwinding of DNA, providing increased access of genome editing system components (e.g., without limitation, catalytically active RNA-guided nuclease and gRNAs) to the desired target region to be edited (e.g., the CCAAT box target region, 13 nt target region, proximal HBG1/2 promoter target sequence, and/or the GATA1 binding motif in BCL11Ae). In certain embodiments, the RNA-guided nuclease may be a catalytically active RNA-guided nuclease with nuclease activity. In certain embodiments, the RNA-guided helicase may be configured to lack nuclease activity. For example, in certain embodiments, the RNA-guided helicase may be a catalytically inactive RNA-guided nuclease that lacks nuclease activity, such as a catalytically dead Cas9 molecule, which still provides helicase activity. In certain embodiments, an RNA-guided helicase may form a complex with a dead gRNA, forming a dead RNP that cannot cleave nucleic acid. In other embodiments, the RNA-guided helicase may be a catalytically active RNA-guided nuclease complexed to a dead gRNA, forming a dead RNP that cannot cleave nucleic acid. In certain embodiments, the RNA-guided nuclease is not configured to recruit an exogenous trans-acting factor to the desired target region to be edited (e.g., the CCAAT box target region, 13 nt target region, proximal HBG1/2 promoter target sequence, and/or the GATA1 binding motif in BCL11Ae).

Turning to dead gRNAs, these include any of the dead gRNAs discussed herein and infra under the heading entitled "Dead gRNA molecules." Dead gRNAs (also referred to herein as "dgRNAs") may be generated by truncating the 5' end of a gRNA targeting domain sequence, resulting in a targeting domain sequence of 15 nucleotides or fewer in length. In certain embodiments, a dgRNA may be generated by truncating the 5' end of any one of a gRNA targeting domain sequence disclosed herein in Table 2 or Table 10. Dead guide RNA molecules according to the present disclosure include dead guide RNA molecules that have reduced, low, or undetectable cleavage activity. The targeting domain sequences of dead guide RNAs may be shorter in length by 1, 2, 3, 4, 5, 6, 7, 8, 9, or 10 nucleotides compared to the targeting domain sequence of active guide RNAs. Dead gRNA molecules may comprise targeting domains complementary to regions proximal to or within a target region (e.g., the CCAAT box target region, 13 nt target region, proximal HBG1/2 promoter target sequence, and/or the GATA1 binding motif in BCL11Ae) in a target nucleic acid. In certain embodiments, "proximal to" may denote the region within 10, 25, 50, 100, or 200 nucleotides of a target region (e.g., the CCAAT box target region, 13 nt target region, proximal HBG1/2 promoter target sequence, and/or the GATA1 binding motif in BCL11Ae). In certain embodiments, dead gRNAs comprise targeting domains complementary to the transcription strand or non-transcription strand of DNA. In certain embodiments, the dead guide RNA is not configured to recruit an exogenous trans-acting factor to a target region (e.g., the CCAAT box target region, 13 nt target region, proximal HBG1/2 promoter target sequence, and/or the GATA1 binding motif in BCL11Ae).

Also provided herein are methods of increasing a rate of indel formation in a target nucleic acid by unwinding DNA within or proximal to the target region (e.g., the CCAAT box target region, 13 nt target region, proximal HBG1/2 promoter target sequence, and/or the GATA1 binding motif in BCL11Ae) using an RNA-guided helicase, generating a DSB within the target region, and forming an indel in the target region through repair of the DSB. The step of unwinding the DNA using an RNA-guided helicase provides for increased indel formation compared to a method of forming indels that does not use a helicase.

This disclosure further encompasses methods of deleting a segment of a target nucleic acid in a cell, comprising contacting the cell with an RNA-guided helicase and generating a double strand break (DSB) within the target region (e.g., the CCAAT box target region, 13 nt target region, proximal HBG1/2 promoter target sequence, and/or the GATA1 binding motif in BCL11Ae). In certain embodiments, the RNA-guided helicase is configured to associate within or proximal to a target region of the target nucleic acid and unwind double stranded DNA (dsDNA) within or proximal to the target region. In certain embodiments, the target nucleic acid is a promoter region of a gene, a coding region of a gene, a non-coding region of a gene, an intron of a gene, or an exon of a gene. In certain embodiments, the segment of the target nucleic acid to be deleted may is at least about 15, 20, 25, 30, 35, 40, 45, 50, 55, 60, 65, 70, 75, or 100 base pairs in length. In certain embodiments, the DSB is repaired in a manner that deletes the segment of the target nucleic acid.

Genome editing systems configured to introduce alterations of helical structure may be implemented in a variety of ways, as is discussed below in detail. As an example, a genome editing system of this disclosure can be implemented as a ribonucleoprotein complex or a plurality of complexes in which multiple gRNAs are used. In certain embodiments, a ribonucleoprotein complex of the genome editing system may be an RNA-guided helicase complexed to a dead guide RNA. Ribonucleoprotein complexes can be introduced into a target cell using art-known methods, including electroporation, as described in Gori. Genome editing systems incorporating RNA-guided helicases may also be modified in any suitable manner, including without limitation by the inclusion of one or more of a DNA donor template that encodes a specific mutation (such as a deletion or insertion) in or near the target region, and/or an agent that enhances the efficiency with which such mutations are generated including, without limitation, a random oligonucleotide, a small molecule agonist or antagonist of a gene product involved in DNA repair or a DNA damage response, or a peptide agent. These modifications are described in greater detail below, under the heading "Genome Editing Strategies." For clarity, this disclosure includes compositions comprising one or more gRNAs, dead gRNAs, RNA-guided helicases, RNA-guided nucleases, or a combination thereof.

While several of the exemplary embodiments above have focused on DNA unwinding, it should be noted that other helical alterations are within the scope of the present disclosure. These include, without limitation, overwinding, underwinding, increase or decrease of torsional strain on DNA strands within or proximate to a target region (e.g., through topoisomerase activity), denaturation or strand separation, and/or other suitable alterations resulting in modifications of chromatin structure. Each of these alterations may be catalyzed by an RNA-guided activity, or by the recruitment of an endogenous factor to a target region.

Also provided herein are genome editing systems and methods of altering one or more indels (e.g., indel signature) generated by an active guide. As the inventors have discovered herein, pairing of a dead RNP (dRNP) (i.e., a dead guide RNA complexed with an RNA-guided nuclease) and an active RNP (i.e., an active guide RNA complexed with an RNA-guided nuclease) can result in a change of the directionality of the indels (e.g., indel signature) generated by the active RNP alone (without a dRNP). As shown in the examples below, the use of the dead guide RNA may result in an increased frequency of larger deletions extending from the active guide RNA cut site toward the dead guide RNA binding site. Thus, the dead guide RNA may be used to effectively "orient" deletion editing toward a desired target site. In certain embodiments, the use of the dead guide RNA with an active guide RNA may increase the frequency of deletions that are not associated with micro-homologies.

Although the examples disclosed in the Examples section below are directed to alterations of the CCAAT box target region, skilled artisans would contemplate that the genome editing systems, methods, cells and compositions described herein may be used to alter any other target region, for example, without limitation, to increase the frequency of deletions at the target region, increase the frequency of deletions at the target region that are not associated with micro-homologies (e.g., not repaired via MMEJ).

This overview has focused on a handful of exemplary embodiments that illustrate the principles of genome editing systems and CRISPR-mediated methods of altering cells. For clarity, however, this disclosure encompasses modifications and variations that have not been expressly addressed above, but will be evident to those of skill in the art. With that in mind, the following disclosure is intended to illustrate the operating principles of genome editing systems more generally. What follows should not be understood as limiting, but rather illustrative of certain principles of genome editing systems and CRISPR-mediated methods utilizing these systems, which, in combination with the instant disclosure, will inform those of skill in the art about additional implementations and modifications that are within its scope.

Genome Editing Systems

The term "genome editing system" refers to any system having RNA-guided DNA editing activity. Genome editing systems of the present disclosure include at least two components adapted from naturally occurring CRISPR systems: a guide RNA (gRNA) and an RNA-guided nuclease. These two components form a complex that is capable of associating with a specific nucleic acid sequence and editing the DNA in or around that nucleic acid sequence, for instance by making one or more of a single-strand break (an SSB or nick), a double-strand break (a DSB) and/or a point mutation.

In certain embodiments, the genome editing systems in this disclosure may include a helicase for unwinding DNA. In certain embodiments, the helicase may be an RNA-guided helicase. In certain embodiments, the RNA-guided helicase may be an RNA-guided nuclease as described herein, such as a Cas9 or Cpf1 molecule. In certain embodiments, the RNA-guided nuclease is not configured to recruit an exogenous trans-acting factor to a target region. In certain embodiments, the RNA-guided nuclease may be configured to lack nuclease activity. In certain embodiments, the RNA-guided helicase may be complexed with a dead guide RNA as disclosed herein. For example, the dead guide RNA (dgRNA) may comprise a targeting domain sequence less than 15 nucleotides in length. In certain embodiments, the dead guide RNA is not configured to recruit an exogenous trans-acting factor to a target region.

Naturally occurring CRISPR systems are organized evolutionarily into two classes and five types (Makarova 2011, incorporated by reference herein), and while genome editing systems of the present disclosure may adapt components of any type or class of naturally occurring CRISPR system, the embodiments presented herein are generally adapted from Class 2, and type II or V CRISPR systems. Class 2 systems, which encompass types II and V, are characterized by relatively large, multidomain RNA-guided nuclease proteins (e.g., Cas9 or Cpf1) and one or more guide RNAs (e.g., a crRNA and, optionally, a tracrRNA) that form ribonucleoprotein (RNP) complexes that associate with (i.e. target) and cleave specific loci complementary to a targeting (or spacer) sequence of the crRNA. Genome editing systems according to the present disclosure similarly target and edit cellular DNA sequences, but differ significantly from CRISPR systems occurring in nature. For example, the unimolecular guide RNAs described herein do not occur in nature, and both guide RNAs and RNA-guided nucleases according to this disclosure may incorporate any number of non-naturally occurring modifications.

Genome editing systems can be implemented (e.g. administered or delivered to a cell or a subject) in a variety of ways, and different implementations may be suitable for distinct applications. For instance, a genome editing system is implemented, in certain embodiments, as a protein/RNA complex (a ribonucleoprotein, or RNP), which can be included in a pharmaceutical composition that optionally includes a pharmaceutically acceptable carrier and/or an encapsulating agent, such as, without limitation, a lipid or polymer micro- or nano-particle, micelle, or liposome. In certain embodiments, a genome editing system is implemented as one or more nucleic acids encoding the RNA-guided nuclease and guide RNA components described above (optionally with one or more additional components); in certain embodiments, the genome editing system is implemented as one or more vectors comprising such nucleic acids, for instance a viral vector such as an adeno-associated virus (see section below under the heading "Implementation of genome editing systems: delivery, formulations, and routes of administration"); and in certain embodiments, the genome editing system is implemented as a combination of any of the foregoing. Additional or modified implementations that operate according to the principles set forth herein will be apparent to the skilled artisan and are within the scope of this disclosure.

It should be noted that the genome editing systems of the present disclosure can be targeted to a single specific nucleotide sequence, or may be targeted to—and capable of editing in parallel—two or more specific nucleotide sequences through the use of two or more guide RNAs. The use of multiple gRNAs is referred to as "multiplexing" throughout this disclosure, and can be employed to target multiple, unrelated target sequences of interest, or to form multiple SSBs or DSBs within a single target domain and, in some cases, to generate specific edits within such target domain. For example, International Patent Publication No. WO 2015/138510 by Maeder et al. ("Maeder"), which is incorporated by reference herein, describes a genome editing system for correcting a point mutation (C.2991+1655A to G) in the human CEP290 gene that results in the creation of a cryptic splice site, which in turn reduces or eliminates the function of the gene. The genome editing system of Maeder utilizes two guide RNAs targeted to sequences on either side of (i.e. flanking) the point mutation, and forms DSBs that flank the mutation. This, in turn, promotes deletion of the intervening sequence, including the mutation, thereby eliminating the cryptic splice site and restoring normal gene function.

As another example, WO 2016/073990 by Cotta-Ramusino et al. ("Cotta-Ramusino"), which is incorporated by reference herein, describes a genome editing system that utilizes two gRNAs in combination with a Cas9 nickase (a Cas9 that makes a single strand nick such as S. pyogenes D10A), an arrangement termed a "dual-nickase system." The dual-nickase system of Cotta-Ramusino is configured to make two nicks on opposite strands of a sequence of interest that are offset by one or more nucleotides, which nicks combine to create a double strand break having an overhang (5' in the case of Cotta-Ramusino, though 3' overhangs are also possible). The overhang, in turn, can facilitate homology directed repair events in some circumstances. And, as another example, WO 2015/070083 by Palestrant et al. (incorporated by reference herein) describes a gRNA targeted to a nucleotide sequence encoding Cas9 (referred to as a "governing RNA"), which can be included in a genome editing system comprising one or more additional gRNAs to permit transient expression of a Cas9 that might otherwise be constitutively expressed, for example in some virally transduced cells. These multiplexing applications are intended to be exemplary, rather than limiting, and the skilled artisan will appreciate that other applications of multiplexing are generally compatible with the genome editing systems described here.

As disclosed herein, in certain embodiments, genome editing systems may comprise multiple gRNAs that may be used to introduce mutations into the GATA1 binding motif in BCL11Ae or the 13 nt target region of HBG1 and/or HBG2. In certain embodiments, genome editing systems disclosed herein may comprise multiple gRNAs used to introduce mutations into the GATA1 binding motif in BCL11Ae and the 13 nt target region of HBG1 and/or HBG2.

Genome editing systems can, in some instances, form double strand breaks that are repaired by cellular DNA double-strand break mechanisms such as NHEJ or HDR. These mechanisms are described throughout the literature (see, e.g., Davis & Maizels 2014 (describing Alt-HDR); Frit 2014 (describing Alt-NHEJ); Iyama & Wilson 2013 (describing canonical HDR and NHEJ pathways generally)).

Where genome editing systems operate by forming DSBs, such systems optionally include one or more components that promote or facilitate a particular mode of double-strand break repair or a particular repair outcome. For instance, Cotta-Ramusino also describes genome editing systems in which a single stranded oligonucleotide "donor template" is added; the donor template is incorporated into a target region of cellular DNA that is cleaved by the genome editing system, and can result in a change in the target sequence.

In certain embodiments, genome editing systems modify a target sequence, or modify expression of a gene in or near the target sequence, without causing single- or double-strand breaks. For example, a genome editing system may include an RNA-guided nuclease fused to a functional domain that acts on DNA, thereby modifying the target sequence or its expression. As one example, an RNA-guided nuclease can be connected to (e.g. fused to) a cytidine deaminase functional domain, and may operate by generating targeted C-to-A substitutions. Exemplary nuclease/deaminase fusions are described in Komor 2016, which is incorporated by reference herein. Alternatively, a genome editing system may utilize a cleavage-inactivated (i.e. a "dead") nuclease, such as a dead Cas9 (dCas9), and may operate by forming stable complexes on one or more targeted regions of cellular DNA, thereby interfering with functions involving the targeted region(s) including, without limitation, mRNA transcription, chromatin remodeling, etc. In certain embodiments, a genome editing system may include an RNA-guided helicase that unwinds DNA within or proximal to the target sequence, without causing single- or double-stranded breaks. For example a genome editing system may include an RNA-guided helicase configured to associate within or near the target sequence to unwind DNA and induce accessibility to the target sequence. In certain embodiments, the RNA-guided helicase may be complexed to a dead guide RNA that is configured to lack cleavage activity allowing for unwinding of the DNA without causing breaks in the DNA.

Guide RNA (gRNA) Molecules

The terms "guide RNA" and "gRNA" refer to any nucleic acid that promotes the specific association (or "targeting") of an RNA-guided nuclease such as a Cas9 or a Cpf1 to a target sequence such as a genomic or episomal sequence in a cell. gRNAs can be unimolecular (comprising a single RNA molecule, and referred to alternatively as chimeric), or modular (comprising more than one, and typically two, separate RNA molecules, such as a crRNA and a tracrRNA, which are usually associated with one another, for instance by duplexing). gRNAs and their component parts are described throughout the literature (see, e.g., Briner 2014, which is incorporated by reference; Cotta-Ramusino). Examples of modular and unimolecular gRNAs that may be used according to the embodiments herein include, without limitation, the sequences set forth in SEQ ID NOs:29-31 and 38-51. Examples of gRNA proximal and tail domains that may be used according to the embodiments herein include, without limitation, the sequences set forth in SEQ ID NOs:32-37.

In bacteria and archea, type II CRISPR systems generally comprise an RNA-guided nuclease protein such as Cas9, a CRISPR RNA (crRNA) that includes a 5' region that is complementary to a foreign sequence, and a trans-activating crRNA (tracrRNA) that includes a 5' region that is complementary to, and forms a duplex with, a 3' region of the crRNA. While not intending to be bound by any theory, it is thought that this duplex facilitates the formation of—and is necessary for the activity of—the Cas9/gRNA complex. As type II CRISPR systems were adapted for use in gene editing, it was discovered that the crRNA and tracrRNA could be joined into a single unimolecular or chimeric guide RNA, in one non-limiting example, by means of a four nucleotide (e.g. GAAA) "tetraloop" or "linker" sequence bridging complementary regions of the crRNA (at its 3' end) and the tracrRNA (at its 5' end). (Mali 2013; Jiang 2013; Jinek 2012; all incorporated by reference herein).

Guide RNAs, whether unimolecular or modular, include a "targeting domain" that is fully or partially complementary to a target domain within a target sequence, such as a DNA sequence in the genome of a cell where editing is desired. Targeting domains are referred to by various names in the literature, including without limitation "guide sequences" (Hsu 2013, incorporated by reference herein), "complementarity regions" (Cotta-Ramusino), "spacers" (Briner 2014) and generically as "crRNAs" (Jiang). Irrespective of the names they are given, targeting domains are typically 10-30 nucleotides in length, and in certain embodiments are 16-24 nucleotides in length (for instance, 16, 17, 18, 19, 20, 21, 22, 23 or 24 nucleotides in length), and are at or near the 5' terminus of in the case of a Cas9 gRNA, and at or near the 3' terminus in the case of a Cpf1 gRNA.

In addition to the targeting domains, gRNAs typically (but not necessarily, as discussed below) include a plurality of domains that may influence the formation or activity of gRNA/Cas9 complexes. For instance, as mentioned above, the duplexed structure formed by first and secondary complementarity domains of a gRNA (also referred to as a repeat:anti-repeat duplex) interacts with the recognition (REC) lobe of Cas9 and can mediate the formation of Cas9/gRNA complexes (Nishimasu 2014; Nishimasu 2015; both incorporated by reference herein). It should be noted that the first and/or second complementarity domains may contain one or more poly-A tracts, which can be recognized by RNA polymerases as a termination signal. The sequence of the first and second complementarity domains are, therefore, optionally modified to eliminate these tracts and promote the complete in vitro transcription of gRNAs, for instance through the use of A-G swaps as described in Briner 2014, or A-U swaps. These and other similar modifications to the first and second complementarity domains are within the scope of the present disclosure.

Along with the first and second complementarity domains, Cas9 gRNAs typically include two or more additional duplexed regions that are involved in nuclease activity in vivo but not necessarily in vitro. (Nishimasu 2015). A first stem-loop one near the 3' portion of the second complementarity domain is referred to variously as the "proximal domain," (Cotta-Ramusino) "stem loop 1" (Nishimasu 2014 and 2015) and the "nexus" (Briner 2014). One or more additional stem loop structures are generally present near the 3' end of the gRNA, with the number varying by species: *S. pyogenes* gRNAs typically include two 3' stem loops (for a total of four stem loop structures including the repeat:anti-repeat duplex), while *S. aureus* and other species have only one (for a total of three stem loop structures). A description of conserved stem loop structures (and gRNA structures more generally) organized by species is provided in Briner 2014.

While the foregoing description has focused on gRNAs for use with Cas9, it should be appreciated that other RNA-guided nucleases exist which utilize gRNAs that differ in some ways from those described to this point. For instance, Cpf1 ("CRISPR from *Prevotella* and Franciscella 1") is a recently discovered RNA-guided nuclease that does not require a tracrRNA to function. (Zetsche 2015, incorporated by reference herein). A gRNA for use in a Cpf1 genome editing system generally includes a targeting domain and a complementarity domain (alternately referred to as a "handle"). It should also be noted that, in gRNAs for use with Cpf1, the targeting domain is usually present at or near the 3' end, rather than the 5' end as described above in connection with Cas9 gRNAs (the handle is at or near the 5' end of a Cpf1 gRNA). Exemplary targeting domains of Cpf1 gRNAs are set forth in Table 13 and Table 18.

Those of skill in the art will appreciate, however, that although structural differences may exist between gRNAs from different prokaryotic species, or between Cpf1 and Cas9 gRNAs, the principles by which gRNAs operate are generally consistent. Because of this consistency of operation, gRNAs can be defined, in broad terms, by their targeting domain sequences, and skilled artisans will appreciate that a given targeting domain sequence can be incorporated in any suitable gRNA, including a unimolecular or chimeric gRNA, or a gRNA that includes one or more chemical modifications and/or sequential modifications (substitutions, additional nucleotides, truncations, etc.).

Thus, for economy of presentation in this disclosure, gRNAs may be described solely in terms of their targeting domain sequences.

More generally, skilled artisans will appreciate that some aspects of the present disclosure relate to systems, methods and compositions that can be implemented using multiple RNA-guided nucleases. For this reason, unless otherwise specified, the term gRNA should be understood to encompass any suitable gRNA that can be used with any RNA-guided nuclease, and not only those gRNAs that are compatible with a particular species of Cas9 or Cpf1. By way of illustration, the term gRNA can, in certain embodiments, include a gRNA for use with any RNA-guided nuclease occurring in a Class 2 CRISPR system, such as a type II or type V or CRISPR system, or an RNA-guided nuclease derived or adapted therefrom.

gRNA Design

Methods for selection and validation of target sequences as well as off-target analyses have been described previously (see, e.g., Mali 2013; Hsu 2013; Fu 2014; Heigwer 2014; Bae 2014; Xiao 2014). Each of these references is incorporated by reference herein. As a non-limiting example, gRNA design may involve the use of a software tool to optimize the choice of potential target sequences corresponding to a user's target sequence, e.g., to minimize total off-target activity across the genome. While off-target activity is not limited to cleavage, the cleavage efficiency at each off-target sequence can be predicted, e.g., using an experimentally-derived weighting scheme. These and other guide selection methods are described in detail in Maeder and Cotta-Ramusino.

With respect to selection of gRNA targeting domain sequences directed to HBG1/2 target sites (e.g. the 13 nt target region), an in-silico gRNA target domain identification tool was utilized, and the hits were stratified into four tiers. For S. pyogenes, tier 1 targeting domains were selected based on (1) distance upstream or downstream from either end of the target site (i.e., HBG1/2 13 nt target region), specifically within 400 bp of either end of the target site, (2) a high level of orthogonality, and (3) the presence of 5' G. Tier 2 targeting domains were selected based on (1) distance upstream or downstream from either end of the target site (i.e., HBG1/2 13 nt target region), specifically within 400 bp of either end of the target site, and (2) a high level of orthogonality. Tier 3 targeting domains were selected based on (1) distance upstream or downstream from either end of the target site (i.e., HBG1/2 13 nt target region), specifically within 400 bp of either end of the target site and (2) the presence of 5' G. Tier 4 targeting domains were selected based on distance upstream or downstream from either end of the target site (i.e., HBG1/2 13 nt target region), specifically within 400 bp of either end of the target site.

For S. aureus, tier 1 targeting domains were selected based on (1) distance upstream or downstream from either end of the target site (i.e., HBG1/2 13 nt target region), specifically within 400 bp of either end of the target site, (2) a high level of orthogonality, (3) the presence of 5' G, and (4) PAM having the sequence NNGRRT (SEQ ID NO:204). Tier 2 targeting domains were selected based on (1) distance upstream or downstream from either end of the target site (i.e., HBG1/2 13 nt target), specifically within 400 bp of either end of the target site, (2) a high level of orthogonality, and (3) PAM having the sequence NNGRRT (SEQ ID NO:204). Tier 3 targeting domains were selected based on (1) distance upstream or downstream from either end of the target site (i.e., HBG1/2 13 nt target region), specifically within 400 bp of either end of the target site, and (2) PAM having the sequence NNGRRT (SEQ ID NO:204). Tier 4 targeting domains were selected based on (1) distance upstream or downstream from either end of the target site (i.e., HBG1/2 13 nt target), specifically within 400 bp of either end of the target site, and (2) PAM having the sequence NNGRRV (SEQ ID NO:205).

Table 2, below, presents targeting domains for S. pyogenes and S. aureus gRNAs, broken out by (a) tier (1, 2, 3 or 4) and (b) HBG1 or HBG2.

TABLE 2 gRNA targeting domain sequences for HBG1/2 target sites

| | HBG1 | HBG2 |
|---|---|---|
| | | S. pyogenes |
| Tier 1 | 251-256 | 760-764 |
| Tier 2 | 257-274 | 765-781 |
| Tier 3 | 275-300 | 275-281, 283-300 |
| Tier 4 | 301-366 | 301-311, 313-342, 344-348, 350-366, 782, 783 |
| | | S. aureus |
| Tier 1 | 367-376 | 784-791 |
| Tier 2 | 343, 377-393 | 778, 792-803 |
| Tier 3 | 357, 365, 394-461 | 357, 365, 394-461 |
| Tier 4 | 252-254, 256, 268, 272-274, 292, 295, 347, 348, 353, 360-362, 366, 598-759 | 292, 295, 347, 348, 353, 360-362, 366, 462-468 476-481, 489-587, 601-607, 614-620, 640-666, 674-679, 687-693, 708-714, 733-753, 762-764, 775, 779-781, 804-901 |

Additional gRNA sequences that were designed to target alteration of the CCAAT box target region include, but are not limited to, the sequences set forth in SEQ ID NOs:970 and 971. Targeting domain sequences of gRNAs that were designed to target disruption of the CCAAT box target region include, but are not limited to, SEQ ID NO: 1002. Targeting domain sequences plus PAM (UUUG) of gRNAs that were designed to target disruption of the CCAAT box target region include, but are not limited to, SEQ ID NO:1004. In certain embodiments, gRNAs comprising the sequence set forth in SEQ ID NOs:1002 and/or 1004 may be complexed with a Cpf1 protein or modified Cpf1 protein to generate alterations at the CCAAT box target region. In certain embodiments, gRNAs comprising any of the Cpf1 gRNAs set forth in Table 15, Table 18, or Table 19 may be complexed with a Cpf1 protein or modified Cpf1 protein forming an RNP ("gRNA-Cpf1-RNP") to generate alterations at the CCAAT box target region. In certain embodiments, the modified Cpf1 protein may be His-AsCpf1-nNLS (SEQ ID NO: 1000) or His-AsCpf1-sNLS-sNLS (SEQ ID NO: 1001). In certain embodiments, the Cpf1 molecule of the gRNA-Cpf1-RNP may be encoded by a sequence set forth in SEQ ID NOs:1000, 1001, 1008-1018, 1032, 1035-39 (Cpf1 polypeptide sequences) or SEQ ID NOs:1019-1021 (Cpf1 polynucleotide sequences).

gRNAs may be designed to target the erythroid specific enhancer of BCL11A (BCL11Ae) to disrupt expression of a transcriptional repressor, BCL11A (described in Friedland, which is incorporated by reference herein). gRNAs were designed to target the GATA1 binding motif that is in the erythroid specific enhancer of BCL11A that is in the +58 DHS region of intron 2 (i.e., the GATA1 binding motif in BCL11Ae), where the +58 DHS enhancer region comprises the sequence set forth in SEQ ID NO:968. Targeting domain sequences of gRNAs that were designed to target disruption of the GATA1 binding motif in BCL11Ae, include, but are not limited to, the sequences set forth in SEQ ID NOs:952-955. Targeting domain sequences plus PAM (NGG) of gRNAs that were designed to target disruption of the GATA1 binding motif in BCL11Ae, include, but are not limited to, the sequences set forth in SEQ ID NOs:960-963.

gRANA Modifications

The activity, stability, or other characteristics of gRNAs can be altered through the incorporation of certain modifications. As one example, transiently expressed or delivered nucleic acids can be prone to degradation by, e.g., cellular nucleases. Accordingly, the gRNAs described herein can contain one or more modified nucleosides or nucleotides which introduce stability toward nucleases. While not wishing to be bound by theory it is also believed that certain modified gRNAs described herein can exhibit a reduced innate immune response when introduced into cells. Those of skill in the art will be aware of certain cellular responses commonly observed in cells, e.g., mammalian cells, in response to exogenous nucleic acids, particularly those of viral or bacterial origin. Such responses, which can include induction of cytokine expression and release and cell death, may be reduced or eliminated altogether by the modifications presented herein.

Certain exemplary modifications discussed in this section can be included at any position within a gRNA sequence including, without limitation at or near the 5' end (e.g., within 1-10, 1-5, or 1-2 nucleotides of the 5' end) and/or at or near the 3' end (e.g., within 1-10, 1-5, or 1-2 nucleotides of the 3' end). In some cases, modifications are positioned within functional motifs, such as the repeat-anti-repeat duplex of a Cas9 gRNA, a stem loop structure of a Cas9 or Cpf1 gRNA, and/or a targeting domain of a gRNA.

As one example, the 5' end of a gRNA can include a eukaryotic mRNA cap structure or cap analog (e.g., a G(5)ppp(5)G cap analog, a m7G(5)ppp(5')G cap analog, or a 3'-O-Me-m7G(5')ppp(5')G anti reverse cap analog (ARCA)), as shown below:

transcribed gRNA, can include either or both of a 5' cap structure or cap analog and a 3' polyA tract.

Guide RNAs can be modified at a 3' terminal U ribose. For example, the two terminal hydroxyl groups of the U ribose can be oxidized to aldehyde groups and a concomitant opening of the ribose ring to afford a modified nucleoside as shown below:

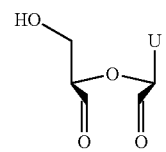

wherein "U" can be an unmodified or modified uridine.

The 3' terminal U ribose can be modified with a 2'3' cyclic phosphate as shown below:

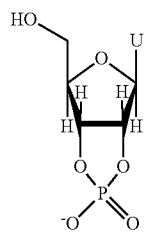

wherein "U" can be an unmodified or modified uridine.

Guide RNAs can contain 3' nucleotides which can be stabilized against degradation, e.g., by incorporating one or more of the modified nucleotides described herein. In certain embodiments, uridines can be replaced with modified uridines, e.g., 5-(2-amino)propyl uridine, and 5-bromo uridine,

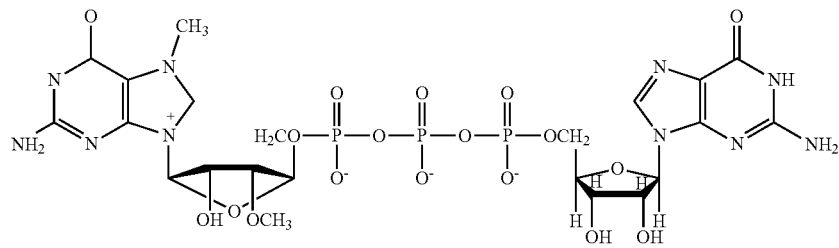

The cap or cap analog can be included during either chemical synthesis or in vitro transcription of the gRNA.

Along similar lines, the 5' end of the gRNA can lack a 5' triphosphate group. For instance, in vitro transcribed gRNAs can be phosphatase-treated (e.g., using calf intestinal alkaline phosphatase) to remove a 5' triphosphate group.

Another common modification involves the addition, at the 3' end of a gRNA, of a plurality (e.g., 1-10, 10-20, or 25-200) of adenine (A) residues referred to as a polyA tract. The polyA tract can be added to a gRNA during chemical synthesis, following in vitro transcription using a polyadenosine polymerase (e.g., E. coli Poly(A)Polymerase), or in vivo by means of a polyadenylation sequence, as described in Maeder.

It should be noted that the modifications described herein can be combined in any suitable manner, e.g. a gRNA, whether transcribed in vivo from a DNA vector, or in vitro or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein.

In certain embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroayl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroalylamino, or amino acid); or cyano (—CN). In certain embodiments, the phosphate backbone can be modified as described herein, e.g., with a phosphorothioate (PhTx) group. In certain embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

Guide RNAs can also include "locked" nucleic acids (LNA) in which the 2' OH-group can be connected, e.g., by a C1-6 alkylene or C1-6 heteroalkylene bridge, to the 4' carbon of the same ribose sugar. Any suitable moiety can be used to provide such bridges, include without limitation methylene, propylene, ether, or amino bridges; O-amino (wherein amino can be, e.g., $NH_2$; alkylamino, dialkylamino, heterocyclyl, arylamino, diarylamino, heteroarylamino, or diheteroalylamino, ethylenediamine, or polyamino) and aminoalkoxy or $O(CH_2)_n$-amino (wherein amino can be, e.g., $NH_2$; alkylamino, dialkylamino, heterocyclyl, arylamino, diarylamino, heteroarylamino, or diheteroarylamino, ethylenediamine, or polyamino).

In certain embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'→2')).

Generally, gRNAs include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In certain embodiments, a gRNA comprises a 4'-S, 4'-Se or a 4'-C-aminomethyl-2'-O-Me modification.

In certain embodiments, deazanucleotides, e.g., 7-deazaadenosine, can be incorporated into the gRNA. In certain embodiments, O- and N-alkylated nucleotides, e.g., N6-methyl adenosine, can be incorporated into the gRNA. In certain embodiments, one or more or all of the nucleotides in a gRNA are deoxynucleotides.

In certain embodiments, gRNAs as used herein may be modified or unmodified gRNAs. In certain embodiments, a gRNA may include one or more modifications. In certain embodiments, the one or more modifications may include a phosphorothioate linkage modification, a phosphorodithioate (PS2) linkage modification, a 2'-O-methyl modification, or combinations thereof. In certain embodiments, the one or more modifications may be at the 5' end of the gRNA, at the 3' end of the gRNA, or combinations thereof.

In certain embodiments, a gRNA modification may comprise one or more phosphorodithioate (PS2) linkage modifications.

In some embodiments, a gRNA used herein includes one or more or a stretch of deoxyribonucleic acid (DNA) bases, also referred to herein as a "DNA extension." In some embodiments, a gRNA used herein includes a DNA extension at the 5' end of the gRNA, the 3' end of the gRNA, or a combination thereof. In certain embodiments, the DNA extension may be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 DNA bases long. For example, in certain embodiments, the DNA extension may be 1, 2, 3, 4, 5, 10, 15, 20, or 25 DNA bases long. In certain embodiments, the DNA extension may include one or more DNA bases selected from adenine (A), guanine (G), cytosine (C), or thymine (T). In certain embodiments, the DNA extension includes the same DNA bases. For example, the DNA extension may include a stretch of adenine (A) bases. In certain embodiments, the DNA extension may include a stretch of thymine (T) bases. In certain embodiments, the DNA extension includes a combination of different DNA bases. In certain embodiments, a DNA extension may comprise a sequence set forth in Table 24. For example, a DNA extension may comprise a sequence set forth in SEQ ID NOs:1235-1250. In certain embodiments, a gRNA used herein includes a DNA extension as well as one or more phosphorothioate linkage modifications, one or more phosphorodithioate (PS2) linkage modifications, one or more 2'-O-methyl modifications, or combinations thereof. In certain embodiments, the one or more modifications may be at the 5' end of the gRNA, at the 3' end of the gRNA, or combinations thereof. In certain embodiments, a gRNA including a DNA extension may comprise a sequence set forth in Table 19 that includes a DNA extension. In a particular embodiment, a gRNA including a DNA extension may comprise the sequence set forth in SEQ ID NO:1051. In certain embodiments, a gRNA including a DNA extension may comprise a sequence selected from the group consisting of SEQ ID NOs:1046-1060, 1067, 1068, 1074, 1075, 1078, 1081-1084, 1086-1087, 1089-1090, 1092-1093, 1098-1102, and 1106. Without wishing to be bound by theory, it is contemplated that any DNA extension may be used herein, so long as it does not hybridize to the target nucleic acid being targeted by the gRNA and it also exhibits an increase in editing at the target nucleic acid site relative to a gRNA which does not include such a DNA extension.

In some embodiments, a gRNA used herein includes one or more or a stretch of ribonucleic acid (RNA) bases, also referred to herein as an "RNA extension." In some embodiments, a gRNA used herein includes an RNA extension at the 5' end of the gRNA, the 3' end of the gRNA, or a combination thereof. In certain embodiments, the RNA extension may be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 RNA bases long. For example, in certain embodiments, the RNA extension may be 1, 2, 3, 4, 5, 10, 15, 20, or 25 RNA bases long. In certain embodiments, the RNA extension may include one or more RNA bases selected from adenine (rA), guanine (rG), cytosine (rC), or uracil (rU), in which the "r" represents RNA, 2'-hydroxy. In certain embodiments, the RNA extension includes the same RNA bases. For example, the RNA extension may include a stretch of adenine (rA) bases. In certain embodiments, the RNA extension includes a combination of different RNA bases. In certain embodiments, an RNA extension may comprise a sequence set forth in Table 24, For example, an RNA extension may comprise a sequence set forth in 1231-1234, 1251-1253. In certain embodiments, a gRNA used herein includes an RNA extension as well as one or more phosphorothioate linkage modifications, one or more phosphorodithioate (PS2) linkage modifications, one or more 2'-O-methyl modifications, or combinations thereof. In certain embodiments, the one or more modifications may be at the 5' end of the gRNA, at the 3' end of the gRNA, or combinations thereof. In certain embodiments, a gRNA including a RNA extension may comprise a sequence set forth in Table 19 that includes an RNA extension. gRNAs including an RNA extension at the 5' end of the gRNA may comprise a sequence selected from the group consisting of SEQ ID NOs:1042-1045, 1103-1105. gRNAs including an RNA extension at the 3' end of the gRNA may comprise a sequence selected from the group consisting of SEQ ID NOs:1070-1075, 1079, 1081, 1098-1100.

It is contemplated that gRNAs used herein may also include an RNA extension and a DNA extension. In certain embodiments, the RNA extension and DNA extension may both be at the 5' end of the gRNA, the 3' end of the gRNA, or a combination thereof. In certain embodiments, the RNA extension is at the 5' end of the gRNA and the DNA extension is at the 3' end of the gRNA. In certain embodiments, the RNA extension is at the 3' end of the gRNA and the DNA extension is at the 5' end of the gRNA.

In some embodiments, a gRNA which includes both a phosphorothioate modification at the 3' end as well as a DNA extension at the 5' end is complexed with a RNA-guided nuclease, e.g., Cpf1, to form an RNP, which is then employed to edit a hematopoietic stem cell (HSC) or a CD34+ cell ex vivo (i.e., outside the body of a subject from whom such a cell is derived), at the HBG locus.

An example of a gRNA as used herein comprises the sequence set forth in SEQ ID NO:1051.

Dead gRNA Molecules

Dead guide RNA (dgRNA) molecules according to the present disclosure include dead guide RNA molecules that comprise reduced, low, or undetectable cleavage activity. The targeting domain sequences of dead guide RNAs are shorter in length by 1, 2, 3, 4, 5, 6, 7, 8, 9, or 10 nucleotides compared to the targeting domain sequence of active guide RNAs. In certain embodiments, dead guide RNA molecules may comprise a targeting domain comprising 15 nucleotides or fewer in length, 14 nucleotides or fewer in length, 13 nucleotides or fewer in length, 12 nucleotides or fewer in length, or 11 nucleotides or fewer in length. In some embodiments, dead guide RNAs are configured such that they do not provide an RNA guided-nuclease cleavage event. Dead guide RNAs may be generated by removing the 5' end of a gRNA targeting domain sequence, which results in a truncated targeting domain sequence. For example, if a gRNA sequence, configured to provide a cleavage event (i.e., 17 nucleotides or more in length), has a targeting domain sequence that is 20 nucleotides in length, a dead guide RNA may be created by removing 5 nucleotides from the 5' end of the gRNA sequence. For example, dgRNAs used herein may comprise a targeting domain set forth in Table 2 or Table 10 that has been truncated from the 5' end of the gRNA sequence and comprises 15 nucleotides or fewer in length. In certain embodiments, the dgRNA may be configured to bind (or associate with) a nucleic acid sequence within or proximal to a target region (e.g., the CCAAT box target region, 13 nt target region, proximal HBG1/2 promoter target sequence, and/or the GATA1 binding motif in BCL11Ae) to be edited. For example, any of the dgRNAs set forth in Table 10 may be employed to bind a nucleic acid sequence proximal to the 13 nt target region or CCAAT box target region. In certain embodiments, proximal to may denote the region within 10, 25, 50, 100, or 200 nucleotides of a target region (e.g., the CCAAT box target region, 13 nt target region, proximal HBG1/2 promoter target sequence, and/or the GATA1 binding motif in BCL11Ae). In certain embodiments, the dead guide RNA is not configured to recruit an exogenous trans-acting factor to a target region. In certain embodiments, the dgRNA is configured such that it does not provide a DNA cleavage event when complexed with an RNA-guided nuclease. Skilled artisans will appreciate that dead guide RNA molecules may be designed to comprise targeting domains complementary to regions proximal to or within a target region in a target nucleic acid. In certain embodiments, dead guide RNAs comprise targeting domain sequences that are complementary to the transcription strand or non-transcription strand of double stranded DNA. The dgRNAs herein may include modifications at the 5' and 3' end of the dgRNA as described for guide RNAs in the section "gRNA modifications" herein. For example, in certain embodiments, dead guide RNAs may include an anti-reverse cap analog (ARCA) at the 5' end of the RNA. In certain embodiments, dgRNAs may include a polyA tail at the 3' end.

In certain embodiments, the use of a dead guide RNA with the genome editing systems and methods disclosed herein may increase the total editing level of an active guide RNA. In certain embodiments, the use of a dead guide RNA with the genome editing systems disclosed herein and methods thereof may increase the frequency of deletions. In certain embodiments, the deletions may extend from the cut site of the active guide RNA toward the dead guide RNA binding site. In this way the dead guide RNA can change the directionality of an active guide RNA and orient editing toward a desired target region.

As used herein, the terms "dead gRNA" and "truncated gRNA" are used interchangeably.

RNA-Guided Nucleases

RNA-guided nucleases according to the present disclosure include, but are not limited to, naturally-occurring Class 2 CRISPR nucleases such as Cas9, and Cpf1, as well as other nucleases derived or obtained therefrom. It has also been shown that certain RNA-guided nucleases, such as Cas9, also have helicase activity that enables them to unwind nucleic acid. In certain embodiments, the RNA-guided helicases according to the present disclosure may be any of the RNA-nucleases described herein and supra in the section entitled "RNA-guided nucleases." In certain embodiments, the RNA-guided nuclease is not configured to recruit an exogenous trans-acting factor to a target region. In certain embodiments, an RNA-guided helicase may be an RNA-guided nuclease configured to lack nuclease activity. For example, in certain embodiments, an RNA-guided helicase may be a catalytically inactive RNA-guided nuclease that lacks nuclease activity, but still retains its helicase activity. In certain embodiments, an RNA-guided nuclease may be mutated to abolish its nuclease activity (e.g., dead Cas9), creating a catalytically inactive RNA-guided nuclease that is unable to cleave nucleic acid, but which can still unwind DNA. In certain embodiments, an RNA-guided helicase may be complexed with any of the dead guide RNAs as described herein. For example, a catalytically active RNA-guided helicase (e.g., Cas9 or Cpf1) may form an RNP complex with a dead guide RNA, resulting in a catalytically inactive dead RNP (dRNP). In certain embodiments, a catalytically inactive RNA-guided helicase (e.g., dead Cas9) and a dead guide RNA may form a dRNP. These dRNPs, although incapable of providing a cleavage event, still retain their helicase activity that is important for unwinding nucleic acid.

In functional terms, RNA-guided nucleases are defined as those nucleases that: (a) interact with (e.g. complex with) a gRNA; and (b) together with the gRNA, associate with, and optionally cleave or modify, a target region of a DNA that includes (i) a sequence complementary to the targeting domain of the gRNA and, optionally, (ii) an additional sequence referred to as a "protospacer adjacent motif," or "PAM," which is described in greater detail below. As the following examples will illustrate, RNA-guided nucleases can be defined, in broad terms, by their PAM specificity and cleavage activity, even though variations may exist between individual RNA-guided nucleases that share the same PAM specificity or cleavage activity. Skilled artisans will appreciate that some aspects of the present disclosure relate to systems, methods and compositions that can be implemented using any suitable RNA-guided nuclease having a certain PAM specificity and/or cleavage activity. For this reason, unless otherwise specified, the term RNA-guided nuclease should be understood as a generic term, and not limited to any particular type (e.g. Cas9 vs. Cpf1), species (e.g. *S. pyogenes* vs. *S. aureus*) or variation (e.g. full-length vs. truncated or split; naturally-occurring PAM specificity vs. engineered PAM specificity, etc.) of RNA-guided nuclease.

Various RNA-guided nucleases may require different sequential relationships between PAMs and protospacers. In general, Cas9s recognize PAM sequences that are 3' of the protospacer. Cpf1, on the other hand, generally recognizes PAM sequences that are 5' of the protospacer.

In addition to recognizing specific sequential orientations of PAMs and protospacers, RNA-guided nucleases can also recognize specific PAM sequences. *S. aureus* Cas9, for instance, recognizes a PAM sequence of NNGRRT or NNGRRV, wherein the N residues are immediately 3' of the region recognized by the gRNA targeting domain. *S. pyogenes* Cas9 recognizes NGG PAM sequences. And *F. novicida* Cpf1 recognizes a TTN PAM sequence. PAM sequences have been identified for a variety of RNA-guided nucleases, and a strategy for identifying novel PAM sequences has been described by Shmakov 2015. It should also be noted that engineered RNA-guided nucleases can have PAM specificities that differ from the PAM specificities of reference molecules (for instance, in the case of an engineered RNA-guided nuclease, the reference molecule may be the naturally occurring variant from which the RNA-guided nuclease is derived, or the naturally occurring variant having the greatest amino acid sequence homology to the engineered RNA-guided nuclease). Examples of PAMs that may be used according to the embodiments herein include, without limitation, the sequences set forth in SEQ ID NOs:199-205.

In addition to their PAM specificity, RNA-guided nucleases can be characterized by their DNA cleavage activity: naturally-occurring RNA-guided nucleases typically form DSBs in target nucleic acids, but engineered variants have been produced that generate only SSBs (discussed above and in Ran & Hsu 2013, incorporated by reference herein), or that do not cut at all.

Cas9

Crystal structures have been determined for *S. pyogenes* Cas9 (Jinek 2014), and for *S. aureus* Cas9 in complex with a unimolecular guide RNA and a target DNA (Nishimasu 2014; Anders 2014; and Nishimasu 2015).

A naturally occurring Cas9 protein comprises two lobes: a recognition (REC) lobe and a nuclease (NUC) lobe; each of which comprise particular structural and/or functional domains. The REC lobe comprises an arginine-rich bridge helix (BH) domain, and at least one REC domain (e.g. a REC1 domain and, optionally, a REC2 domain). The REC lobe does not share structural similarity with other known proteins, indicating that it is a unique functional domain. While not wishing to be bound by any theory, mutational analyses suggest specific functional roles for the BH and REC domains: the BH domain appears to play a role in gRNA:DNA recognition, while the REC domain is thought to interact with the repeat:anti-repeat duplex of the gRNA and to mediate the formation of the Cas9/gRNA complex.

The NUC lobe comprises a RuvC domain, an HNH domain, and a PAM-interacting (PI) domain. The RuvC domain shares structural similarity to retroviral integrase superfamily members and cleaves the non-complementary (i.e. bottom) strand of the target nucleic acid. It may be formed from two or more split RuvC motifs (such as RuvC I, RuvCII, and RuvCIII in *S. pyogenes* and *S. aureus*). The HNH domain, meanwhile, is structurally similar to HNN endonuclease motifs, and cleaves the complementary (i.e. top) strand of the target nucleic acid. The PI domain, as its name suggests, contributes to PAM specificity. Examples of polypeptide sequences encoding Cas9 RuvC-like and Cas9 HNH-like domains that may be used according to the embodiments herein are set forth in SEQ ID NOs:15-23, 52-123 (RuvC-like domains) and SEQ ID NOs:24-28, 124-198 (HNH-like domains).

While certain functions of Cas9 are linked to (but not necessarily fully determined by) the specific domains set forth above, these and other functions may be mediated or influenced by other Cas9 domains, or by multiple domains on either lobe. For instance, in *S. pyogenes* Cas9, as described in Nishimasu 2014, the repeat:antirepeat duplex of the gRNA falls into a groove between the REC and NUC lobes, and nucleotides in the duplex interact with amino acids in the BH, PI, and REC domains. Some nucleotides in the first stem loop structure also interact with amino acids in multiple domains (PI, BH and REC1), as do some nucleotides in the second and third stem loops (RuvC and PI domains). Examples of polypeptide sequences encoding Cas9 molecules that may be used according to the embodiments herein are set forth in SEQ ID NOs:1-2, 4-6, 12, and 14.

Cpf1

The crystal structure of *Acidaminococcus* sp. Cpf1 in complex with crRNA and a double-stranded (ds) DNA target including a TTTN PAM sequence has been solved by Yamano 2016 (incorporated by reference herein). Cpf1, like Cas9, has two lobes: a REC (recognition) lobe, and a NUC (nuclease) lobe. The REC lobe includes REC1 and REC2 domains, which lack similarity to any known protein structures. The NUC lobe, meanwhile, includes three RuvC domains (RuvC-I, -II and -III) and a BH domain. However, in contrast to Cas9, the Cpf1 REC lobe lacks an HNH domain, and includes other domains that also lack similarity to known protein structures: a structurally unique PI domain, three Wedge (WED) domains (WED-I, -II and -III), and a nuclease (Nuc) domain.

While Cas9 and Cpf1 share similarities in structure and function, it should be appreciated that certain Cpf1 activities are mediated by structural domains that are not analogous to any Cas9 domains. For instance, cleavage of the complementary strand of the target DNA appears to be mediated by the Nuc domain, which differs sequentially and spatially from the HNH domain of Cas9. Additionally, the non-targeting portion of Cpf1 gRNA (the handle) adopts a pseudoknot structure, rather than a stem loop structure formed by the repeat:antirepeat duplex in Cas9 gRNAs.

In certain embodiments, a Cpf1 protein may be a modified Cpf1 protein. In certain embodiments, a modified Cpf1 protein may include one or more modifications. In certain embodiments the modifications may be, without limitation, one or more mutations in a Cpf1 nucleotide sequence or Cpf1 amino acid sequence, one or more additional sequences such as a His tag or a nuclear localization signal (NLS), or a combination thereof. In certain embodiments, a modified Cpf1 may also be referred to herein as a Cpf1 variant.

In certain embodiments, the Cpf1 protein may be derived from a Cpf1 protein selected from the group consisting of *Acidaminococcus* sp. strain BV3L6 Cpf1 protein (AsCpf1), Lachnospiraceae bacterium ND2006 Cpf1 protein (LbCpf1), and Lachnospiraceae bacterium MA2020 (Lb2Cpf1). In certain embodiments, the Cpf1 protein may comprise a sequence selected from the group consisting of SEQ ID NOs. 1016-1018, having the codon-optimized nucleic acid sequences of SEQ ID NOs. 1019-1021, respectively.

In certain embodiments, the modified Cpf1 protein may comprise a nuclear localization signal (NLS). For example, but not by way of limitation, NLS sequences useful in connection with the methods and compositions disclosed herein will comprise an amino acid sequence capable of facilitating protein import into the cell nucleus. NLS sequences useful in connection with the methods and compositions disclosed herein are known in the art. Examples of such NLS sequences include the nucleoplasmin NLS having the amino acid sequence: KRPAATKKAGQAKKKK (SEQ ID NO. 1006) and the simian virus 40 "SV40" NLS having the amino acid sequence PKKKRKV (SEQ ID NO. 1007).

In certain embodiments, the NLS sequence of the modified Cpf1 protein is positioned at or near the C-terminus of the Cpf1 protein sequence. For example, but not by way of limitation, the modified Cpf1 protein can be selected from the following: His-AsCpf1-nNLS (SEQ ID NO. 1000); His-AsCpf1-sNLS (SEQ ID NO. 1008) and His-AsCpf1-sNLS-sNLS (SEQ ID NO. 1001), where "His" refers to a six-histidine purification sequence, "AsCpf1" refers to the *Acidaminococcus* sp. Cpf1 protein sequence, "nNLS" refers to the nucleoplasmin NLS, and "sNLS" refers to the SV40 NLS. Additional permutations of the identity and C-terminal positions of NLS sequences, e.g., appending two or more nNLS sequences or combinations of nNLS and sNLS sequences (or other NLS sequences), as well as sequences with and without purification sequences, e.g., six-histidine sequences, are within the scope of the instantly disclosed subject matter.

In certain embodiments, the NLS sequence of the modified Cpf1 protein may be positioned at or near the N-terminus of the Cpf1 protein sequence. For example, but not by way of limitation, the modified Cpf1 protein may be selected from the following: His-sNLS-AsCpf1 (SEQ ID NO. 1009), His-sNLS-sNLS-AsCpf1 (SEQ ID NO. 1010), and sNLS-sNLS-AsCpf1 (SEQ ID NO. 1011). Additional permutations of the identity and N-terminal positions of NLS sequences, e.g., appending two or more nNLS sequences or combinations of nNLS and sNLS sequences (or other NLS sequences), as well as sequences with and without purification sequences, e.g., six-histidine sequences, are within the scope of the instantly disclosed subject matter.

In certain embodiments, the modified Cpf1 protein may comprise NLS sequences positioned at or near both the N-terminus and C-terminus of the Cpf1 protein sequence. For example, but not by way of limitation, the modified Cpf1 protein may be selected from the following: His-sNLS-AsCpf1-sNLS (SEQ ID NO. 1012) and His-sNLS-sNLS-AsCpf1-sNLS-sNLS (SEQ ID NO. 1013). Additional permutations of the identity and N-terminal/C-terminal positions of NLS sequences, e.g., appending two or more nNLS sequences or combinations of nNLS and sNLS sequences (or other NLS sequences) to either the N-terminal/C-terminal positions, as well as sequences with and without purification sequences, e.g., six-histidine sequences, are within the scope of the instantly disclosed subject matter.

In certain embodiments, the modified Cpf1 protein may comprise an alteration (e.g., a deletion or substitution) at one or more cysteine residues of the Cpf1 protein sequence. For example, but not by way of limitation, modified Cpf1 protein may comprise an alteration at a position selected from the group consisting of: C65, C205, C334, C379, C608, C674, C1025, and C1248. In certain embodiments, the modified Cpf1 protein may comprise a substitution of one or more cysteine residues for a serine or alanine. In certain embodiments, the modified Cpf1 protein may comprise an alteration selected from the group consisting of: C65S, C205S, C334S, C379S, C608S, C674S, C1025S, and C1248S. In certain embodiments, the modified Cpf1 protein may comprise an alteration selected from the group consisting of: C65A, C205A, C334A, C379A, C608A, C674A, C1025A, and C1248A. In certain embodiments, the modified Cpf1 protein may comprise alterations at positions C334 and C674 or C334, C379, and C674. In certain embodiments, the modified Cpf1 protein may comprise the following alterations: C334S and C674S, or C334S, C379S, and C674S. In certain embodiments, the modified Cpf1 protein may comprise the following alterations: C334A and C674A, or C334A, C379A, and C674A. In certain embodiments, the modified Cpf1 protein may comprise both one or more cysteine residue alteration as well as the introduction of one or more NLS sequences, e.g., His-AsCpf1-nNLS Cys-less (SEQ ID NO. 1014) or His-AsCpf1-nNLS Cys-low (SEQ ID NO. 1015). In various embodiments, the Cpf1 protein comprising a deletion or substitution in one or more cysteine residues exhibits reduced aggregation.

In certain embodiments, other modified Cpf1 proteins known in the art may be used with the methods and systems described herein. For example, in certain embodiments, the modified Cpf1 may be Cpf1 containing the mutation S542R/K548V/N552R ("Cpf1 RVR"). Cpf1 RVR has been shown to cleave target sites with a TATV PAM. In certain embodiments, the modified Cpf1 may be Cpf1 containing the mutation S542R/K607R ("Cpf1 RR"). Cpf1 RR has been shown to cleave target sites with a TYCV/CCCC PAM.

In some embodiments, a Cpf1 variant is used herein, wherein the Cpf1 variant comprises mutations at one or more residues of AsCpf1 (*Acidaminococcus* sp. BV3L6) selected from the group consisting of 11, 12, 13, 14, 15, 16, 17, 34, 36, 39, 40, 43, 46, 47, 50, 54, 57, 58, 111, 126, 127, 128, 129, 130, 131, 132, 133, 134, 135, 136, 157, 158, 159, 160, 161, 162, 163, 164, 165, 166, 167, 168, 169, 170, 171, 172, 173, 174, 175, 176, 177, 178, 532, 533, 534, 535, 536, 537, 538, 539, 540, 541, 542, 543, 544, 545, 546, 547, 548, 549, 550, 551, 552, 553, 554, 555, 556, 565, 566, 567, 568, 569, 570, 571, 572, 573, 574, 575, 592, 593, 594, 595, 596, 597, 598, 599, 600, 601, 602, 603, 604, 605, 606, 607, 608, 609, 610, 611, 612, 613, 614, 615, 616, 617, 618, 619, 620, 626, 627, 628, 629, 630, 631, 632, 633, 634, 635, 636, 637, 638, 642, 643, 644, 645, 646, 647, 648, 649, 651, 652, 653, 654, 655, 656, 676, 679, 680, 682, 683, 684, 685, 686, 687, 688, 689, 690, 691, 692, 693, 707, 711, 714, 715, 716, 717, 718, 719, 720, 721, 722, 739, 765, 768, 769, 773, 777, 778, 779, 780, 781, 782, 783, 784, 785, 786, 870, 871, 872, 873, 874, 875, 876, 877, 878, 879, 880, 881, 882, 883, 884, or 1048 or the corresponding position of an AsCpf1 orthologue, homologue, or variant.

In certain embodiments, a Cpf1 variant as used herein may include any of the Cpf1 proteins described in International Publication Number WO 2017/184768 A1 by Zhang et al. ("'768 Publication"), which is incorporated by reference herein.

In certain embodiments, a modified Cpf1 protein (also referred to as a Cpf1 variant) used herein may be encoded by any of the sequences set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). Table 20 sets forth exemplary Cpf1 variant amino acid and nucleotide sequences. These sequences are set forth in FIG. 62, which details the positions of six-histidine sequences (underlined letters) and NLS sequences (bolded letters). Additional permutations of the identity and N-terminal/C-terminal positions of NLS sequences, e.g., appending two or more nNLS sequences or combinations of nNLS and sNLS sequences (or other NLS sequences) to either the N-terminal/C-terminal positions, as well as sequences with and without purification sequences, e.g., six-histidine sequences, are within the scope of the instantly disclosed subject matter.

In certain embodiments, any of the Cpf1 proteins or modified Cpf1 proteins disclosed herein may be complexed with one or more gRNA comprising the targeting domain set forth in SEQ ID NOs 1002 and/or 1004 to alter a CCAAT box target region. In certain embodiments, any of the Cpf1 proteins or modified Cpf1 proteins disclosed herein may be complexed with one or more gRNA comprising a sequence set forth in Table 18 or Table 19. In certain embodiments, the modified Cpf1 protein may be His-AsCpf1-nNLS (SEQ ID NO: 1000) or His-AsCpf1-sNLS-sNLS (SEQ ID NO:1001). In certain embodiments, a modified Cpf1 protein used herein may be encoded by any of the sequences set forth in SEQ ID NOs:1000, 1001, 1008-1018, 1032, 1035-39, 1094-1097, 1107-09 (Cpf1 polypeptide sequences) or SEQ ID NOs: 1019-1021, 1110-17 (Cpf1 polynucleotide sequences). In certain embodiments, the modified Cpf1 protein may comprise the sequence set forth in SEQ ID NO: 1097.

Modifications of RNA-Guided Nucleases

The RNA-guided nucleases described above have activities and properties that can be useful in a variety of applications, but the skilled artisan will appreciate that RNA-guided nucleases can also be modified in certain instances, to alter cleavage activity, PAM specificity, or other structural or functional features.

Turning first to modifications that alter cleavage activity, mutations that reduce or eliminate the activity of domains within the NUC lobe have been described above. Exemplary mutations that may be made in the RuvC domains, in the Cas9 HNH domain, or in the Cpf1 Nuc domain are described in Ran & Hsu 2013 and Yamano 2016, as well as in Cotta-Ramusino. In general, mutations that reduce or eliminate activity in one of the two nuclease domains result in RNA-guided nucleases with nickase activity, but it should be noted that the type of nickase activity varies depending on which domain is inactivated. As one example, inactivation of a RuvC domain of a Cas9 will result in a nickase that cleaves the complementary or top strand as shown below (where C denotes the site of cleavage).

On the other hand, inactivation of a Cas9 HNH domain results in a nickase that cleaves the bottom or non-complementary strand.

Modifications of PAM specificity relative to naturally occurring Cas9 reference molecules has been described by Kleinstiver et al. for both *S. pyogenes* (Kleinstiver 2015a) and *S. aureus* (Kleinstiver 2015b). Kleinstiver et al. have also described modifications that improve the targeting fidelity of Cas9 (Kleinstiver 2016). Each of these references is incorporated by reference herein.

RNA-guided nucleases have been split into two or more parts, as described by Zetsche 2015 and Fine 2015 (both incorporated by reference herein).

RNA-guided nucleases can be, in certain embodiments, size-optimized or truncated, for instance via one or more deletions that reduce the size of the nuclease while still retaining gRNA association, target and PAM recognition, and cleavage activities. In certain embodiments, RNA guided nucleases are bound, covalently or non-covalently, to another polypeptide, nucleotide, or other structure, optionally by means of a linker. Exemplary bound nucleases and linkers are described by Guilinger 2014, incorporated by reference herein for all purposes.

RNA-guided nucleases also optionally include a tag, such as, but not limited to, a nuclear localization signal to facilitate movement of RNA-guided nuclease protein into the nucleus. In certain embodiments, the RNA-guided nuclease can incorporate C- and/or N-terminal nuclear localization signals. Nuclear localization sequences are known in the art and are described in Maeder and elsewhere.

The foregoing list of modifications is intended to be exemplary in nature, and the skilled artisan will appreciate, in view of the instant disclosure, that other modifications may be possible or desirable in certain applications. For brevity, therefore, exemplary systems, methods and compositions of the present disclosure are presented with reference to particular RNA-guided nucleases, but it should be understood that the RNA-guided nucleases used may be modified in ways that do not alter their operating principles. Such modifications are within the scope of the present disclosure.

Nucleic Acids Encoding RNA-Guided Nucleases

Nucleic acids encoding RNA-guided nucleases, e.g., Cas9, Cpf1 or functional fragments thereof, are provided herein. Examples of nucleic acid sequences encoding Cas9 molecules that may be used according to the embodiments herein are set forth in SEQ ID NOs:3, 7-11, 13. Exemplary nucleic acids encoding RNA-guided nucleases have been described previously (see, e.g., Cong 2013; Wang 2013; Mali 2013; Jinek 2012).

In some cases, a nucleic acid encoding an RNA-guided nuclease can be a synthetic nucleic acid sequence. For example, the synthetic nucleic acid molecule can be chemically modified. In certain embodiments, an mRNA encoding an RNA-guided nuclease will have one or more (e.g., all) of the following properties: it can be capped; polyadenylated; and substituted with 5-methylcytidine and/or pseudouridine.

Synthetic nucleic acid sequences can also be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein. Examples of codon optimized Cas9 coding sequences are presented in Cotta-Ramusino.

In addition, or alternatively, a nucleic acid encoding an RNA-guided nuclease may comprise a nuclear localization sequence (NLS). Nuclear localization sequences are known in the art.

Functional Analysis of Candidate Molecules

Candidate RNA-guided nucleases, gRNAs, and complexes thereof, can be evaluated by standard methods known in the art. See, e.g. Cotta-Ramusino. The stability of RNP complexes may be evaluated by differential scanning fluorimetry, as described below.

Differential Scanning Fluorimetry (DSF)

The thermostability of ribonucleoprotein (RNP) complexes comprising gRNAs and RNA-guided nucleases can be measured via DSF. The DSF technique measures the thermostability of a protein, which can increase under favorable conditions such as the addition of a binding RNA molecule, e.g., a gRNA.

A DSF assay can be performed according to any suitable protocol, and can be employed in any suitable setting, including without limitation (a) testing different conditions (e.g. different stoichiometric ratios of gRNA: RNA-guided nuclease protein, different buffer solutions, etc.) to identify optimal conditions for RNP formation; and (b) testing modifications (e.g. chemical modifications, alterations of sequence, etc.) of an RNA-guided nuclease and/or a gRNA to identify those modifications that improve RNP formation or stability. One readout of a DSF assay is a shift in melting temperature of the RNP complex; a relatively high shift suggests that the RNP complex is more stable (and may thus have greater activity or more favorable kinetics of formation, kinetics of degradation, or another functional characteristic) relative to a reference RNP complex characterized by a lower shift. When the DSF assay is deployed as a screening tool, a threshold melting temperature shift may be specified, so that the output is one or more RNPs having a melting temperature shift at or above the threshold. For instance, the threshold can be 5-10° C. (e.g. 5°, 6°, 7° 8°, 9°, 10°) or more, and the output may be one or more RNPs characterized by a melting temperature shift greater than or equal to the threshold.

Two non-limiting examples of DSF assay conditions are set forth below:

To determine the best solution to form RNP complexes, a fixed concentration (e.g. 2 µM) of Cas9 in water+10× SYPRO Orange® (Life Technologies cat #S-6650) is dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with fixed concentration (e.g. 2 µM) Cas9 in optimal buffer from assay 1 above and incubating (e.g. at RT for 10') in a 384 well plate. An equal volume of optimal buffer+10×SYPRO Orange® (Life Technologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

Genome Editing Strategies

The genome editing systems described above are used, in various embodiments of the present disclosure, to generate edits in (i.e. to alter) targeted regions of DNA within or obtained from a cell. Various strategies are described herein to generate particular edits, and these strategies are generally described in terms of the desired repair outcome, the number and positioning of individual edits (e.g. SSBs or DSBs), and the target sites of such edits.

Genome editing strategies that involve the formation of SSBs or DSBs are characterized by repair outcomes including: (a) deletion of all or part of a targeted region; (b) insertion into or replacement of all or part of a targeted region; or (c) interruption of all or part of a targeted region. This grouping is not intended to be limiting, or to be binding to any particular theory or model, and is offered solely for economy of presentation. Skilled artisans will appreciate that the listed outcomes are not mutually exclusive and that some repairs may result in other outcomes. The description of a particular editing strategy or method should not be understood to require a particular repair outcome unless otherwise specified.

Replacement of a targeted region generally involves the replacement of all or part of the existing sequence within the targeted region with a homologous sequence, for instance through gene correction or gene conversion, two repair outcomes that are mediated by HDR pathways. HDR is promoted by the use of a donor template, which can be single-stranded or double stranded, as described in greater detail below. Single or double stranded templates can be exogenous, in which case they will promote gene correction, or they can be endogenous (e.g. a homologous sequence within the cellular genome), to promote gene conversion. Exogenous templates can have asymmetric overhangs (i.e. the portion of the template that is complementary to the site of the DSB may be offset in a 3' or 5' direction, rather than being centered within the donor template), for instance as described by Richardson 2016 (incorporated by reference herein). In instances where the template is single stranded, it can correspond to either the complementary (top) or non-complementary (bottom) strand of the targeted region.

Gene conversion and gene correction are facilitated, in some cases, by the formation of one or more nicks in or around the targeted region, as described in Ran & Hsu 2013 and Cotta-Ramusino. In some cases, a dual-nickase strategy is used to form two offset SSBs that, in turn, form a single DSB having an overhang (e.g. a 5' overhang).

Interruption and/or deletion of all or part of a targeted sequence can be achieved by a variety of repair outcomes. As one example, a sequence can be deleted by simultaneously generating two or more DSBs that flank a targeted region, which is then excised when the DSBs are repaired, as is described in Maeder for the LCA10 mutation. As another example, a sequence can be interrupted by a deletion generated by formation of a double strand break with single-stranded overhangs, followed by exonucleolytic processing of the overhangs prior to repair.

One specific subset of target sequence interruptions is mediated by the formation of an indel within the targeted sequence, where the repair outcome is typically mediated by NHEJ pathways (including Alt-NHEJ). NHEJ is referred to as an "error prone" repair pathway because of its association with indel mutations. In some cases, however, a DSB is repaired by NHEJ without alteration of the sequence around it (a so-called "perfect" or "scarless" repair); this generally requires the two ends of the DSB to be perfectly ligated. Indels, meanwhile, are thought to arise from enzymatic processing of free DNA ends before they are ligated that adds and/or removes nucleotides from either or both strands of either or both free ends.

Because the enzymatic processing of free DSB ends may be stochastic in nature, indel mutations tend to be variable, occurring along a distribution, and can be influenced by a variety of factors, including the specific target site, the cell type used, the genome editing strategy used, etc. Even so, it is possible to draw limited generalizations about indel formation: deletions formed by repair of a single DSB are most commonly in the 1-50 bp range, but can reach greater than 100-200 bp. Insertions formed by repair of a single DSB tend to be shorter and often include short duplications of the sequence immediately surrounding the break site. However, it is possible to obtain large insertions, and in these cases, the inserted sequence has often been traced to other regions of the genome or to plasmid DNA present in the cells.

Indel mutations—and genome editing systems configured to produce indels—are useful for interrupting target sequences, for example, when the generation of a specific final sequence is not required and/or where a frameshift mutation would be tolerated. They can also be useful in settings where particular sequences are preferred, insofar as the certain sequences desired tend to occur preferentially from the repair of an SSB or DSB at a given site. Indel mutations are also a useful tool for evaluating or screening the activity of particular genome editing systems and their components. In these and other settings, indels can be characterized by (a) their relative and absolute frequencies in the genomes of cells contacted with genome editing systems and (b) the distribution of numerical differences relative to the unedited sequence, e.g. ±1, ±2, ±3, etc. As one example, in a lead-finding setting, multiple gRNAs can be screened to identify those gRNAs that most efficiently drive cutting at a target site based on an indel readout under controlled conditions. Guides that produce indels at or above a threshold frequency, or that produce a particular distribution of indels, can be selected for further study and development. Indel frequency and distribution can also be useful as a readout for evaluating different genome editing system implementations or formulations and delivery methods, for instance by keeping the gRNA constant and varying certain other reaction conditions or delivery methods.

Multiplex Strategies

Genome editing systems according to this disclosure may also be employed for multiplex gene editing to generate two or more DSBs, either in the same locus or in different loci. Any of the RNA-guided nucleases and gRNAs disclosed herein may be used in genome editing systems for multiplex gene editing. Strategies for editing that involve the formation of multiple DSBs, or SSBs, are described in, for instance, Cotta-Ramusino.

As disclosed herein, multiple gRNAs may be used in genome editing systems to introduce alterations (e.g., deletions, insertions) into the 13 nt target region of HBG1 and/or HBG2. In certain embodiments, one or more gRNAs comprising a targeting domain set forth in SEQ ID NOs:251-901, 940-942 may be used to introduce alterations in the 13 nt target region of HBG1 and/or HBG2. In other embodiments, multiple gRNAs may be used in genome editing systems to introduce alterations into the CCAAT box target region. In certain embodiments, one or more gRNAs comprising a sequence set forth in SEQ ID NOs:970, 971, 996, 997 may be used to introduce alterations in the CCAAT box target region. In certain embodiments, one or more gRNAs comprising a targeting domain set forth in SEQ ID NOs: 1002, 1004 may be used to introduce alterations in the CCAAT box target region. In other embodiments, multiple gRNAs may be used in genome editing systems to introduce alterations into the GATA1 binding motif in BCL11Ae. In certain embodiments, one or more gRNAs comprising a targeting domain set forth in SEQ ID NOs:952-955 may be used to introduce alterations in the GATA1 binding motif in BCL11Ae. Multiple gRNAs may also be used in genome editing systems to introduce alterations into the GATA1 binding motif in BCL11Ae, the CCAAT box target region, the 13 nt target region of HBG1 and/or HBG2, or a combination thereof. In certain embodiments, one or more gRNAs comprising a targeting domain set forth in SEQ ID NOs:952-955 may be used to introduce alterations in the GATA1 binding motif in BCL11Ae and one or more gRNAs comprising a targeting domain set forth in SEQ ID NOs: 251-901, 940-942 may be used to introduce alterations in the 13 nt target region of HBG1 and/or HBG2. In certain embodiments, one or more gRNAs comprising a targeting domain set forth in SEQ ID NOs:952-955 may be used to introduce alterations in the GATA1 binding motif in BCL11Ae and one or more gRNAs or gRNAs comprising a targeting domain set forth in SEQ ID NOs:970, 971, 996, 997 may be used to introduce alterations in the CCAAT box target region. In certain embodiments, one or more gRNAs comprising a targeting domain set forth in SEQ ID NOs: 952-955 may be used to introduce alterations in the GATA1 binding motif in BCL11Ae and one or more gRNAs comprising a targeting domain set forth in SEQ ID NOs:1002, 1004 may be used to introduce alterations in the CCAAT box target region.

In certain embodiments, multiple gRNAs and an RNA-guided nuclease may be used in genome editing systems to introduce alterations (e.g., deletions, insertions) into the CCAAT box target region of HBG1 and/or HBG2. In certain embodiments, the RNA-guided nuclease may be a Cas9, modified Cas9 (e.g., D10A), Cpf1, or modified Cpf1.

Donor Template Design

Donor template design is described in detail in the literature, for instance in Cotta-Ramusino. DNA oligomer donor templates (oligodeoxynucleotides or ODNs), which can be single stranded (ssODNs) or double-stranded (dsODNs), can be used to facilitate HDR-based repair of DSBs or to boost overall editing rate, and are particularly useful for introducing alterations into a target DNA sequence, inserting a new sequence into the target sequence, or replacing the target sequence altogether.

Whether single-stranded or double stranded, donor templates generally include regions that are homologous to regions of DNA within or near (e.g. flanking or adjoining) a target sequence to be cleaved. These homologous regions are referred to here as "homology arms," and are illustrated schematically below:

[5' homology arm]→[replacement sequence]→[3' homology arm].

The homology arms can have any suitable length (including 0 nucleotides if only one homology arm is used), and 3' and 5' homology arms can have the same length, or can differ in length. The selection of appropriate homology arm lengths can be influenced by a variety of factors, such as the desire to avoid homologies or microhomologies with certain sequences such as Alu repeats or other very common elements. For example, a 5' homology arm can be shortened to avoid a sequence repeat element. In other embodiments, a 3' homology arm can be shortened to avoid a sequence repeat element. In some embodiments, both the 5' and the 3' homology arms can be shortened to avoid including certain sequence repeat elements. In addition, some homology arm designs can improve the efficiency of editing or increase the frequency of a desired repair outcome. For example, Richardson 2016, which is incorporated by reference herein, found that the relative asymmetry of 3' and 5' homology arms of single stranded donor templates influenced repair rates and/or outcomes.

Replacement sequences in donor templates have been described elsewhere, including in Cotta-Ramusino. A replacement sequence can be any suitable length (including zero nucleotides, where the desired repair outcome is a deletion), and typically includes one, two, three or more sequence modifications relative to the naturally-occurring sequence within a cell in which editing is desired. One common sequence modification involves the alteration of the naturally-occurring sequence to repair a mutation that is related to a disease or condition of which treatment is desired. Another common sequence modification involves the alteration of one or more sequences that are complementary to, or then, the PAM sequence of the RNA-guided nuclease or the targeting domain of the gRNA(s) being used to generate an SSB or DSB, to reduce or eliminate repeated cleavage of the target site after the replacement sequence has been incorporated into the target site.

Where a linear ssODN is used, it can be configured to (i) anneal to the nicked strand of the target nucleic acid, (ii) anneal to the intact strand of the target nucleic acid, (iii) anneal to the plus strand of the target nucleic acid, and/or (iv) anneal to the minus strand of the target nucleic acid. An ssODN may have any suitable length, e.g., about, at least, or no more than 80-200 nucleotides (e.g., 80, 90, 100, 110, 120, 130, 140, 150, 160, 170, 180, 190, or 200 nucleotides).

It should be noted that a template nucleic acid can also be a nucleic acid vector, such as a viral genome or circular double stranded DNA, e.g., a plasmid. Nucleic acid vectors comprising donor templates can include other coding or non-coding elements. For example, a template nucleic acid can be delivered as part of a viral genome (e.g. in an AAV or lentiviral genome) that includes certain genomic backbone elements (e.g. inverted terminal repeats, in the case of an AAV genome) and optionally includes additional sequences coding for a gRNA and/or an RNA-guided nuclease. In certain embodiments, the donor template can be adjacent to, or flanked by, target sites recognized by one or more gRNAs, to facilitate the formation of free DSBs on one or both ends of the donor template that can participate in repair of corresponding SSBs or DSBs formed in cellular DNA using the same gRNAs. Exemplary nucleic acid vectors suitable for use as donor templates are described in Cotta-Ramusino, which is incorporated by reference.

Whatever format is used, a template nucleic acid can be designed to avoid undesirable sequences. In certain embodiments, one or both homology arms can be shortened to avoid overlap with certain sequence repeat elements, e.g., Alu repeats, LINE elements, etc.

In certain embodiments, silent, non-pathogenic SNPs may be included in the ssODN donor template to allow for identification of a gene editing event.

In certain embodiments, a donor template may be a non-specific template that is non-homologous to regions of DNA within or near a target sequence to be cleaved. In certain embodiments, donor templates for use in targeting the GATA1 binding motif in BCL11Ae may include, without limitation, non-target specific templates that are nonhomologous to regions of DNA within or near the GATA1 binding motif in BCL11Ae. In certain embodiments, donor templates for use in targeting the 13 nt target region may include, without limitation, non-target specific templates that are nonhomologous to regions of DNA within or near the 13 nt target region.

A donor template or template nucleic acid, as that term is used herein, refers to a nucleic acid sequence which can be used in conjunction with an RNA nuclease molecule and one or more gRNA molecules to alter (e.g., delete, disrupt, or modify) a target DNA sequence. In certain embodiments, the template nucleic acid results in an alteration (e.g., deletion) at the CCAAT box target region of HBG1 and/or HBG2. In certain embodiments, the alteration is anon-naturally occurring alteration. In certain embodiments, the non-naturally occurring alteration at the CCAAT box target region of HBG1 and/or HBG2 may comprise the 18 nt target region, the 11 nt target region, the 4 nt target region, or the 1 nt target region, or a combination thereof. In certain embodiments, the alteration is a naturally occurring alteration. In certain embodiments, the naturally occurring alteration at the CCAAT box target region of HBG1 and/or HBG2 may comprise the 13 nt target region, the c.-117 G>A target region, or a combination thereof. In certain embodiments, the template nucleic acid is an ssODN. In certain embodiments, the ssODN is a positive strand or a negative strand.

For example, a template nucleic acid for introducing the 18 nt deletion at the 18 nt target region (HBG1 c.-104 to -121, HBG2 c.-104 to -121, or a combination thereof) may comprise a 5' homology arm, a replacement sequence, and a 3' homology arm, where the replacement sequence is 0 nucleotides or 0 bp. In certain embodiments, the 5' homology arm may be about 25 to about 200 nucleotides or more in length, e.g., at least about 25, 50, 75, 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the 18 nt target region. In certain embodiments, the 3' homology arm may be about 25 to about 200 nucleotides or more in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the 18 nt target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:974 (OLI16409) or SEQ ID NO:975 (OLI16410).

In certain embodiments, a template nucleic acid for introducing the 11 nt deletion at the 11 nt target region (HBG1 c.-105 to -115, HBG2 c.-105 to -115, or a combination thereof) may comprise a 5' homology arm, a replacement sequence, and a 3' homology arm, where the replacement sequence is 0 nucleotides or 0 bp. In certain embodiments, the 5' homology arm may be about 25 to about 200 nucleotides in length, e.g., at least about 25, 50, 75, 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the 11 nt target region. In certain embodiments, the 3' homology arm may be about 25 to about 200 nucleotides in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the 11 nt target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:976 (OLI16411) or SEQ ID NO:978 (OLI16413).

In certain embodiments, a template nucleic acid for introducing the 4 nt deletion at the 4 nt target region (HBG1 c.-112 to -115, HBG2 c.-112 to -115, or a combination thereof) may comprise a 5' homology arm, a replacement sequence, and a 3' homology arm, where the replacement sequence is 0 nucleotides or 0 bp. In certain embodiments, the 5' homology arm may be about 25 to about 200 nucleotides in length, e.g., at least about 25, 50, 75, 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the 4 nt target region. In certain embodiments, the 3' homology arm may be about 25 to about 200 nucleotides in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the 4 nt target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:984 (OLI16419), SEQ ID NO:985 (OLI16420), SEQ ID NO:986 (OLI16421), SEQ ID NO:987 (OLI16422), SEQ ID NO:988 (OLI16423), SEQ ID NO:989 (OLI16424), SEQ ID NO:990 (OLI16425), SEQ ID NO:991 (OLI16426), SEQ ID NO:992(OLI16427), SEQ ID NO:993 (OLI16428), SEQ ID NO:994 (OLI16429), or SEQ ID NO:995 (OLI16430).

In certain embodiments, a template nucleic acid for introducing the 1 nt deletion at the 1 nt target region (HBG1 c.-116, HBG2 c.-116, or a combination thereof) may comprise a 5' homology arm, a replacement sequence, and a 3' homology arm, where the replacement sequence is 0 nucleotides or 0 bp. In certain embodiments, the 5' homology arm may be about 25 to about 200 nucleotides in length, e.g., at least about 25, 50, 75, 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the 1 nt target region. In certain embodiments, the 3' homology arm may be about 25 to about 200 nucleotides in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the 1 nt target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:982 (OLI16417) or SEQ ID NO:983 (OLI16418).

In certain embodiments, the alteration at the CCAAT box target region recapitulates or is similar to a naturally occurring alteration, such as a 13 nt deletion. In certain embodiments, a template nucleic acid for introducing the 13 nt deletion at the 13 nt target region (HBG1 c.-116, HBG2 c.-116, or a combination thereof) may comprise a 5' homology arm, a replacement sequence, and a 3' homology arm, where the replacement sequence is 0 nucleotides or 0 bp. In certain embodiments, the 5' homology arm may be about 25 to about 200 nucleotides in length, e.g., at least about 25, 50, 75, 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the 13 nt target region. In certain embodiments, the 3' homology arm may be about 25 to about 200 nucleotides in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the 13 nt target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:979 (OLI16414) or SEQ ID NO:977 (OLI16412).

In certain embodiments, the alteration at the CCAAT box target region recapitulates or is similar to a naturally occurring alteration, such as a substitution from G to A at the −117G>A target region. In certain embodiments, a template nucleic acid for introducing the −117G>A substitution at the −117G>A target region (HBG1 c.-117 G>A, HBG2 c.-117 G>A, or a combination thereof) may comprise a 5' homology arm, a replacement sequence, and a 3' homology arm, where the replacement sequence is 0 nucleotides or 0 bp. In certain embodiments, the 5' homology arm may be about 100 to about 200 nucleotides in length, e.g., at least about 100, 125, 150, 175, or 200 nucleotides in length. In certain embodiments, the 5' homology arm comprises about 50 to 100 bp, e.g., 55 to 95, 60 to 90, 70 to 90, or 80 to 90 bp, homology 5' of the −117G>A target region. In certain embodiments, the 3' homology arm may be about 25 to about 200 nucleotides in length, e.g., at least about 25, 50, 75, 100, 125, 150, 175, or 200 nucleotides in length. In certain embodiments, the 3' homology arm comprises about 50 to 100 bp, e.g., 55 to 95, 60 to 90, 70 to 90, or 80 to 90 bp, homology 3' of the −117G>A target region. In certain embodiments, the 5' and 3' homology arms are symmetrical in length. In certain embodiments, the 5' and 3' homology arms are asymmetrical in length. In certain embodiments, the template nucleic acid is an ssODN. In certain embodiments, the ssODN is a positive strand. In certain embodiments, the ssODN is a negative strand. In certain embodiments, the ssODN comprises, consists essentially of, or consists of SEQ ID NO:980 (OLI16415) or SEQ ID NO:981 (OLI16416).

In certain embodiments, the 5' homology arm comprises a 5' phosphorothioate (PhTx) modification. In certain embodiments, the 3' homology arm comprises a 3' PhTx modification. In certain embodiments, the template nucleic acid comprises a 5' and 3' PhTx modification.

In certain embodiments, the ssODNs for introducing alterations (e.g., deletions) at the CCAAT box target region may be used in conjunction with an RNA nuclease and one or more gRNAs that target the CCAAT target region, for example, the gRNAs disclosed in Table 7, Table 10, Table 12, Table 13, Table 18, Table 19.

Target Cells

Genome editing systems according to this disclosure can be used to manipulate or alter a cell, e.g., to edit or alter a target nucleic acid. The manipulating can occur, in various embodiments, in vivo or ex vivo.

A variety of cell types can be manipulated or altered according to the embodiments of this disclosure, and in some cases, such as in vivo applications, a plurality of cell types are altered or manipulated, for example by delivering genome editing systems according to this disclosure to a plurality of cell types. In other cases, however, it may be desirable to limit manipulation or alteration to a particular cell type or types. For instance, it can be desirable in some instances to edit a cell with limited differentiation potential or a terminally differentiated cell, such as a photoreceptor cell in the case of Maeder, in which modification of a genotype is expected to result in a change in cell phenotype. In other cases, however, it may be desirable to edit a less differentiated, multipotent or pluripotent, stem or progenitor cell. By way of example, the cell may be an embryonic stem cell, induced pluripotent stem cell (iPSC), hematopoietic stem/progenitor cell (HSPC), or other stem or progenitor cell type that differentiates into a cell type of relevance to a given application or indication.

As a corollary, the cell being altered or manipulated is, variously, a dividing cell or a non-dividing cell, depending on the cell type(s) being targeted and/or the desired editing outcome.

When cells are manipulated or altered ex vivo, the cells can be used (e.g. administered to a subject) immediately, or they can be maintained or stored for later use. Those of skill in the art will appreciate that cells can be maintained in culture or stored (e.g. frozen in liquid nitrogen) using any suitable method known in the art.

Implementation of Genome Editing Systems: Delivery, Formulations, and Routes of Administration As discussed above, the genome editing systems of this disclosure can be implemented in any suitable manner, meaning that the components of such systems, including without limitation the RNA-guided nuclease, gRNA, and optional donor template nucleic acid, can be delivered, formulated, or administered in any suitable form or combination of forms that results in the transduction, expression or introduction of a genome editing system and/or causes a desired repair outcome in a cell, tissue or subject. Tables 3 and 4 set forth several, non-limiting examples of genome editing system implementations. Those of skill in the art will appreciate, however, that these listings are not comprehensive, and that other implementations are possible. With reference to Table 3 in particular, the table lists several exemplary implementations of a genome editing system comprising a single gRNA and an optional donor template. However, genome editing systems according to this disclosure can incorporate multiple gRNAs, multiple RNA-guided nucleases, and other components such as proteins, and a variety of implementations will be evident to the skilled artisan based on the principles illustrated in the table. In the table, [N/A] indicates that the genome editing system does not include the indicated component.

TABLE 3

Genome Editing System Components

| RNA-guided Nuclease | gRNA | Donor Template | Comments |
| --- | --- | --- | --- |
| Protein | RNA | [N/A] | An RNA-guided nuclease protein complexed with a gRNA molecule (an RNP complex) |
| Protein | RNA | DNA | An RNP complex as described above plus a single-stranded or double stranded donor template. |
| Protein | DNA | [N/A] | An RNA-guided nuclease protein plus gRNA transcribed from DNA. |
| Protein | DNA | DNA | An RNA-guided nuclease protein plus gRNA-encoding DNA and a separate DNA donor template. |
| Protein | DNA | | An RNA-guided nuclease protein and a single DNA encoding both a gRNA and a donor template. |
| DNA | | | A DNA or DNA vector encoding an RNA-guided nuclease, a gRNA and a donor template. |
| DNA | DNA | [N/A] | Two separate DNAs, or two separate DNA vectors, encoding the RNA-guided nuclease and the gRNA, respectively. |
| DNA | DNA | DNA | Three separate DNAs, or three separate DNA vectors, encoding the RNA-guided nuclease, the gRNA and the donor template, respectively. |
| DNA | | [N/A] | A DNA or DNA vector encoding an RNA-guided nuclease and a gRNA |
| DNA | | DNA | A first DNA or DNA vector encoding an RNA-guided nuclease and a gRNA, and a second DNA or DNA vector encoding a donor template. |
| DNA | DNA | | A first DNA or DNA vector encoding an RNA-guided nuclease and second DNA or DNA vector encoding a gRNA and a donor template. |
| | DNA DNA | | A first DNA or DNA vector encoding an RNA-guided nuclease and a donor template, and a second DNA or DNA vector encoding a gRNA |
| | DNA RNA | | A DNA or DNA vector encoding an RNA-guided nuclease and a donor template, and a gRNA |
| RNA | | [N/A] | An RNA or RNA vector encoding an RNA-guided nuclease and comprising a gRNA |
| RNA | | DNA | An RNA or RNA vector encoding an RNA-guided nuclease and comprising a gRNA, and a DNA or DNA vector encoding a donor template. |

Table 4 summarizes various delivery methods for the components of genome editing systems, as described herein. Again, the listing is intended to be exemplary rather than limiting.

TABLE 4

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends om what is delivered | Nucleic Acids and Proteins |
| | Polymeric Nanoparticles | YES | Transient | Depends om what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

Nucleic Acid-Based Delivery of Genome Editing Systems

Nucleic acids encoding the various elements of a genome editing system according to the present disclosure can be administered to subjects or delivered into cells by art-known methods or as described herein. For example, RNA-guided nuclease-encoding and/or gRNA-encoding DNA, as well as donor template nucleic acids can be delivered by, e.g., vectors (e.g., viral or non-viral vectors), non-vector based methods (e.g., using naked DNA or DNA complexes), or a combination thereof.

Nucleic acids encoding genome editing systems or components thereof can be delivered directly to cells as naked DNA or RNA, for instance by means of transfection or electroporation, or can be conjugated to molecules (e.g., N-acetylgalactosamine) promoting uptake by the target cells (e.g., erythrocytes, HSCs). Nucleic acid vectors, such as the vectors summarized in Table 4, can also be used.

Nucleic acid vectors can comprise one or more sequences encoding genome editing system components, such as an RNA-guided nuclease, a gRNA and/or a donor template. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40).

The nucleic acid vector can also include any suitable number of regulatory/control elements, e.g., promoters, enhancers, introns, polyadenylation signals, Kozak consensus sequences, or internal ribosome entry sites (IRES). These elements are well known in the art, and are described in Cotta-Ramusino.

Nucleic acid vectors according to this disclosure include recombinant viral vectors. Exemplary viral vectors are set forth in Table 4, and additional suitable viral vectors and their use and production are described in Cotta-Ramusino. Other viral vectors known in the art can also be used. In addition, viral particles can be used to deliver genome editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art, and are summarized in Cotta-Ramusino. Any suitable nanoparticle design can be used to deliver genome editing system components or nucleic acids encoding such components. For instance, organic (e.g. lipid and/or polymer) nonparticles can be suitable for use as delivery vehicles in certain embodiments of this disclosure. Exemplary lipids for use in nanoparticle formulations, and/or gene transfer are shown in Table 5, and Table 6 lists exemplary polymers for use in gene transfer and/or nanoparticle formulations.

TABLE 5

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)propyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3- dimethylaminopropane | DLinDMA | Cationic |
| 2,2-dilinoleyl-4-dimethylaminoethyl-[1,3]- dioxolane | DLin-KC2-DMA | Cationic |
| dilinoleyl- methyl-4-dimethylaminobutyrate | DLin-MC3-DMA | Cationic |

TABLE 6

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly (phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Non-viral vectors optionally include targeting modifications to improve uptake and/or selectively target certain cell types. These targeting modifications can include e.g., cell specific antigens, monoclonal antibodies, single chain antibodies, aptamers, polymers, sugars (e.g., N-acetylgalactosamine (GalNAc)), and cell penetrating peptides. Such vectors also optionally use fusogenic and endosome-destabilizing peptides/polymers, undergo acid-triggered conformational changes (e.g., to accelerate endosomal escape of the cargo), and/or incorporate a stimuli-cleavable polymer, e.g., for release in a cellular compartment. For example, disulfide-based cationic polymers that are cleaved in the reducing cellular environment can be used.

In certain embodiments, one or more nucleic acid molecules (e.g., DNA molecules) other than the components of a genome editing system, e.g., the RNA-guided nuclease component and/or the gRNA component described herein, are delivered. In certain embodiments, the nucleic acid molecule is delivered at the same time as one or more of the components of the Genome editing system. In certain embodiments, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Genome editing system are delivered. In certain embodiments, the nucleic acid molecule is delivered by a different means than one or more of the components of the genome editing system, e.g., the RNA-guided nuclease component and/or the gRNA component, are delivered. The nucleic acid molecule can be delivered by any of the delivery methods described herein. For example, the nucleic acid molecule can be delivered by a viral vector, e.g., an integration-deficient lentivirus, and the RNA-guided nuclease molecule component and/or the gRNA component can be delivered by electroporation, e.g., such that the toxicity caused by nucleic acids (e.g., DNAs) can be reduced. In certain embodiments, the nucleic acid molecule encodes a therapeutic protein, e.g., a protein described herein. In certain embodiments, the nucleic acid molecule encodes an RNA molecule, e.g., an RNA molecule described herein.

Delivery of RNPs and or RNA Encoding Genome Editing System Components

RNPs (complexes of gRNAs and RNA-guided nucleases) and/or RNAs encoding RNA-guided nucleases and/or gRNAs, can be delivered into cells or administered to subjects by art-known methods, some of which are described in Cotta-Ramusino. In vitro, RNA-guided nuclease-encoding and/or gRNA-encoding RNA can be delivered, e.g., by microinjection, electroporation, transient cell compression or squeezing (see, e.g., Lee 2012). Lipid-mediated transfection, peptide-mediated delivery, GalNAc- or other conjugate-mediated delivery, and combinations thereof, can also be used for delivery in vitro and in vivo. A protective, interactive, non-condensing (PINC) system may be used for delivery.

In vitro delivery via electroporation comprises mixing the cells with the RNA encoding RNA-guided nucleases and/or gRNAs, with or without donor template nucleic acid molecules, in a cartridge, chamber or cuvette and applying one or more electrical impulses of defined duration and amplitude. Systems and protocols for electroporation are known in the art, and any suitable electroporation tool and/or protocol can be used in connection with the various embodiments of this disclosure.

Route of Administration

Genome editing systems, or cells altered or manipulated using such systems, can be administered to subjects by any suitable mode or route, whether local or systemic. Systemic modes of administration include oral and parenteral routes. Parenteral routes include, by way of example, intravenous, intramarrow, intrarterial, intramuscular, intradermal, subcutaneous, intranasal, and intraperitoneal routes. Components administered systemically can be modified or formulated to target, e.g., HSCs, hematopoietic stem/progenitor cells, or erythroid progenitors or precursor cells.

Local modes of administration include, by way of example, intramarrow injection into the trabecular bone or intrafemoral injection into the marrow space, and infusion into the portal vein. In certain embodiments, significantly smaller amounts of the components (compared with systemic approaches) can exert an effect when administered locally (for example, directly into the bone marrow) compared to when administered systemically (for example, intravenously). Local modes of administration can reduce or eliminate the incidence of potentially toxic side effects that may occur when therapeutically effective amounts of a component are administered systemically.

Administration can be provided as a periodic bolus (for example, intravenously) or as continuous infusion from an internal reservoir or from an external reservoir (for example, from an intravenous bag or implantable pump). Components can be administered locally, for example, by continuous release from a sustained release drug delivery device.

In addition, components can be formulated to permit release over a prolonged period of time. A release system can include a matrix of a biodegradable material or a material which releases the incorporated components by diffusion. The components can be homogeneously or heterogeneously distributed within the release system. A variety of release systems can be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used. Typically the microspheres are composed of a polymer of lactic acid and glycolic acid, which are structured to form hollow spheres. The spheres can be approximately 15-30 microns in diameter and can be loaded with components described herein. In some embodiments, genome editing systems, system components and/or nucleic acids encoding system components, are delivered with a block copolymer such as a poloxamer or a poloxamine.

Multi-Modal or Differential Delivery of Components

Skilled artisans will appreciate, in view of the instant disclosure, that different components of genome editing systems disclosed herein can be delivered together or separately and simultaneously or non-simultaneously. Separate and/or asynchronous delivery of genome editing system components can be particularly desirable to provide temporal or spatial control over the function of genome editing systems and to limit certain effects caused by their activity.

Different or differential modes as used herein refer to modes of delivery that confer different pharmacodynamic or pharmacokinetic properties on the subject component molecule, e.g., a RNA-guided nuclease molecule, gRNA, template nucleic acid, or payload. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., AAV or lentivirus, delivery.

By way of example, the components of a genome editing system, e.g., a RNA-guided nuclease and a gRNA, can be delivered by modes that differ in terms of resulting half-life or persistent of the delivered component the body, or in a particular compartment, tissue or organ. In certain embodiments, a gRNA can be delivered by such modes. The RNA-guided nuclease molecule component can be delivered by a mode which results in less persistence or less exposure to the body or a particular compartment or tissue or organ.

More generally, in certain embodiments, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In certain embodiments, the first pharmacodynamic or pharmacokinetic property, e.g., distribution, persistence or exposure, is more limited than the second pharmacodynamic or pharmacokinetic property.

In certain embodiments, the first mode of delivery is selected to optimize, e.g., minimize, a pharmacodynamic or pharmacokinetic property, e.g., distribution, persistence or exposure.

In certain embodiments, the second mode of delivery is selected to optimize, e.g., maximize, a pharmacodynamic or pharmacokinetic property, e.g., distribution, persistence or exposure.

In certain embodiments, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In certain embodiments, the second mode of delivery comprises a relatively transient element, e.g., an RNA or protein.

In certain embodiments, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a RNA-guided nuclease molecule, is delivered in a transient manner, for example as mRNA or as protein, ensuring that the full RNA-guided nuclease molecule/gRNA complex is only present and active for a short period of time.

Furthermore, the components can be delivered in different molecular form or with different delivery vectors that complement one another to enhance safety and tissue specificity.

Use of differential delivery modes can enhance performance, safety, and/or efficacy, e.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in certain embodiments, a first component, e.g., a gRNA is delivered by a first delivery mode that results in a first spatial, e.g., tissue, distribution. A second component, e.g., a RNA-guided nuclease molecule is delivered by a second delivery mode that results in a second spatial, e.g., tissue, distribution. In certain embodiments, the first mode comprises a first element selected from a liposome, nanoparticle, e.g., polymeric nanoparticle, and a nucleic acid, e.g., viral vector. The second mode comprises a second element selected from the group. In certain embodiments, the first mode of delivery comprises a first targeting element, e.g., a cell specific receptor or an antibody, and the second mode of delivery does not include that element. In certain embodiments, the second mode of delivery comprises a second targeting element, e.g., a second cell specific receptor or second antibody.

When the RNA-guided nuclease molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA and the RNA-guided nuclease molecule are packaged in separated delivery vehicles with distinct but overlapping tissue tropism, the fully functional complex is only be formed in the tissue that is targeted by both vectors.

EXAMPLES

The principles and embodiments described above are further illustrated by the non-limiting examples that follow:

Example 1: Screening of *S. pyogenes* gRNAs Delivered to K562 Cells as Ribonucleoprotein Complexes for Use in Causing 13 nt Deletions in HBG1 and HBG2 Regulatory Regions gRNAs targeting a 26 nt fragment spanning and including the 13 nucleotides at the 13 nt target region of HBG1 and HBG2 were designed by standard methods. After gRNAs were designed in silico and tiered, a subset of the gRNAs were selected and screened for activity and specificity in human K562 cells. The gRNAs selected for screening are set forth in Table 7. Briefly, gRNAs were in vitro transcribed and then complexed with *S. pyogenes* wildtype (Wt) Cas9 protein to form ribonucleoprotein complexes (RNPs). The gRNAs complexed to *S. pyogenes* Cas9 protein were modified sgRNAs ((e.g., 5' ARCA capped and 3' polyA (20A) tail;

Table 7) and target the HBG1 and HBG2 regulatory regions. To allow for direct comparison of the activity of these RNPs in K562 cells and human CD34+ cells, RNPs were first delivered to K562 cells by electroporation (Amaxa Nucleofector).

Figure 1:
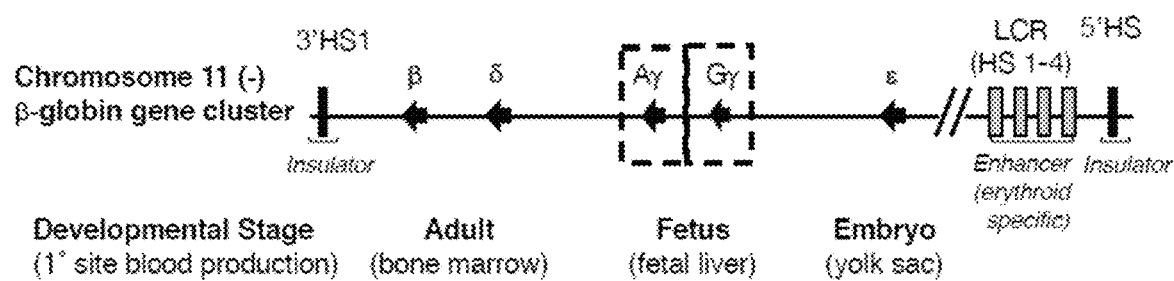
FIG. 1 depicts, in schematic form, HBG1 and HBG2 gene(s) in the context of the β-globin gene cluster on human chromosome 11.
Figure 2A:
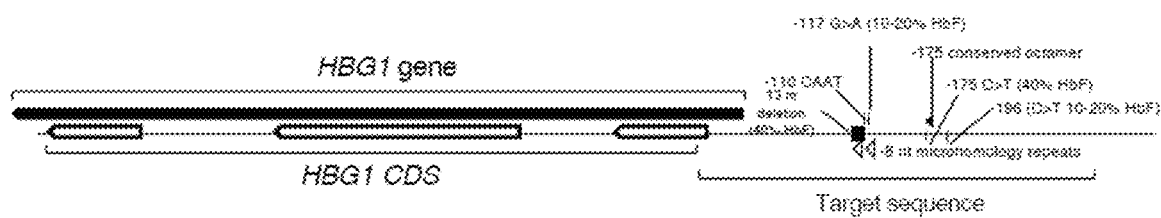
FIGS. 2A-2B depict HBG1 and HBG2 genes, coding sequences (CDS) and small deletions and point mutations in and upstream of the HBG1 and HBG2 proximal promoters that have been identified in patients and associated with elevation of fetal hemoglobin (HbF). Core elements within the proximal promoters (CAAT box, 13 nt sequence) that have been deleted in some patients with hereditary persistence of fetal hemoglobin (HPFH). The 'target sequence' region of each locus, which has been screened for gRNA binding target sites, is also identified.
Figure 2B:
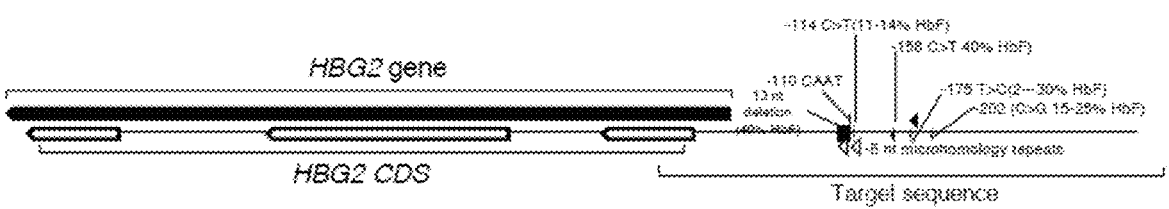
Figure 3A:
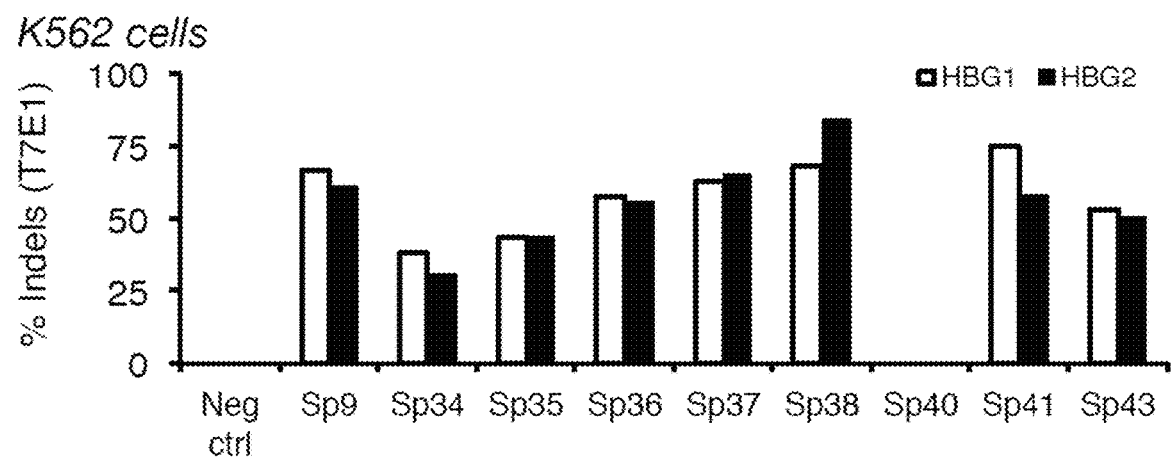
FIGS. 3A-C show data from gRNA screening for incorporation of the 13 nt deletion in human K562 erythroleukemia cells.
Figure 3B:
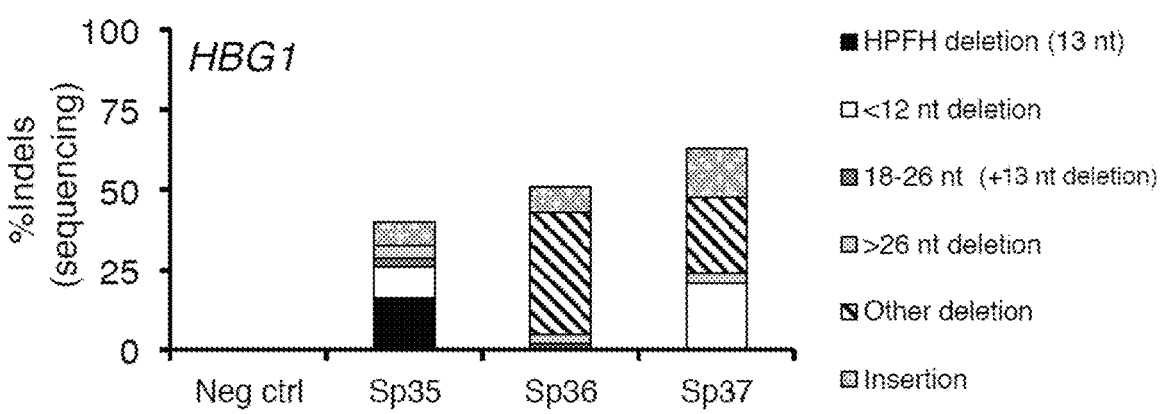
Figure 3C:
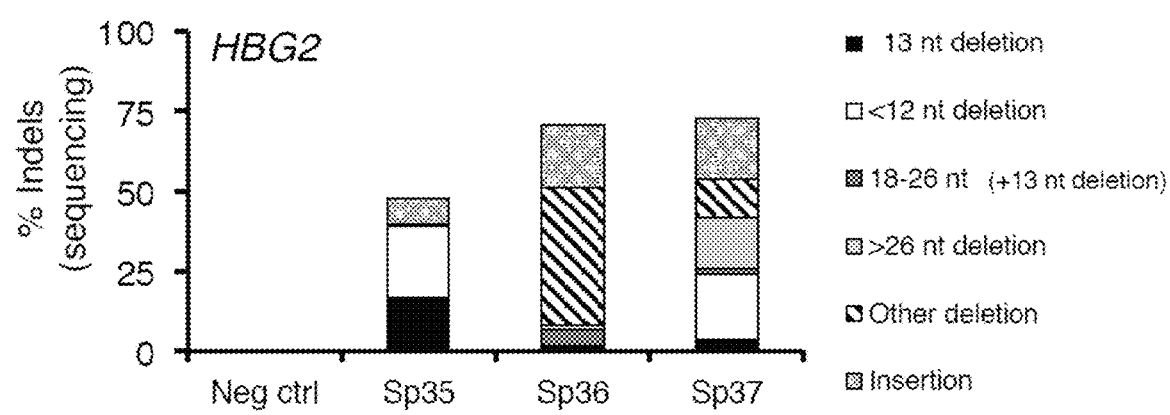

Three days after RNP electroporation, gDNA was extracted from K562 cells and then the HBG1 and HBG2 loci were PCR amplified from the gDNA. Gene editing was evaluated in the PCR products by T7E1 endonuclease assay analysis. Eight out of nine RNPs supported a high percentage of NHEJ. Sp37 RNP, the only gRNA shown to be active in human CD34+ cells (<10% editing in CD34+ cells) was highly active in K562 cells, with >60% indels detected at both HBG1 and HBG2 and eight cut in both the HBG1 and HBG2 targeted regions in the promoter sequences (FIG. 3A).

deletion of the 13 nt (HPFH mutation induction) (FIG. 3B) for HBG1. At least five of the eight sgRNAs also supported targeted deletion of the 13 nt in HBG2 promoter region (FIG. 3C). Note that DNA sequence results for HBG2 in cells treated with HBG Sp34 sgRNA were not available. These data indicate that Cas9 and sgRNA support precise induction of the 13 nt deletions. FIGS. 3B-3C depict examples of the types of deletions observed in target sequences in HBG1.

Figure 4A:
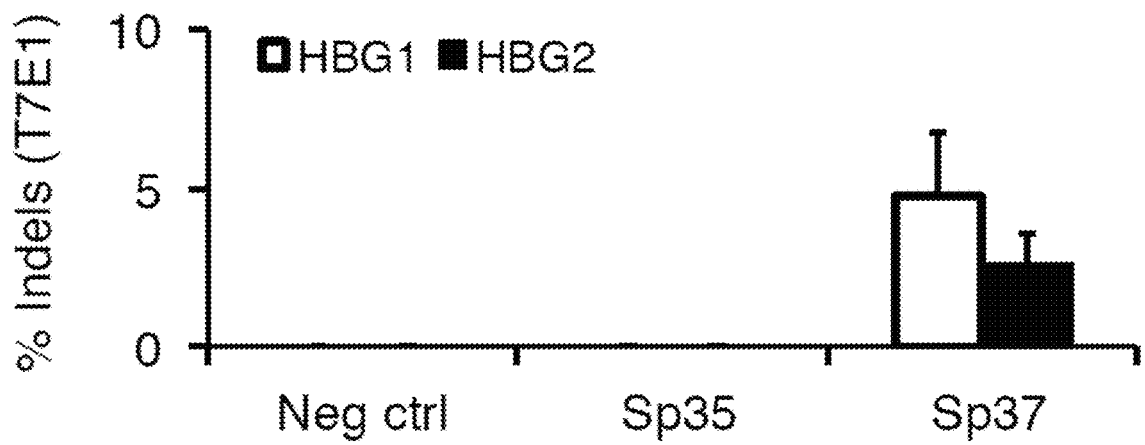
FIGS. 4A-C depict results of gene editing in human cord blood (CB) and human adult CD34+ cells after electroporation with RNPs complexed to in vitro transcribed S. pyogenes gRNAs that target a specific 13 nt sequence for deletion (HBG sgRNAs Sp35 and Sp37).

Example 2: Cas9 RNP Containing gRNA Targeting the 13 nt Deletion Mutation Supports Gene Editing in Human Hematopoietic Stem/Progenitor Cells Of the RNPs containing different gRNAs tested in human cord blood (CB) CD34+ cells, only Sp37 resulted in detectable editing at the target site in the HBG1 and HBG2 promoters as determined by T7E1 analysis of indels in HBG1 and HBG2 specific PCR products amplified from gDNA extracted from electroporated CB CD34+ cells from a three cord blood donors (FIG. 4A). The average level of editing detected in cells electroporated with Cas9 protein complexed to Sp37 was 5±2% indels at HBG1 and 3±1% indels detected at HBG2 (3 separate experiments, and CB donors).

TABLE 7

Selected gRNAs for screening in K562 cells or CD34+ cells

| gRNA ID | Targeting domain sequence (RNA) | Targeting domain sequence (DNA) | Targeting domain sequence plus PAM (NGG) (RNA) | Targeting domain sequence plus PAM (NGG) (DNA) | Sense |
|---|---|---|---|---|---|
| Sp9 | GGCUAUUGGU CAAGGCA (SEQ ID NO: 277) | GGCTATTGGTCA AGGCA (SEQ ID NO: 910) | GGCUAUUGGUCA AGGCAAGG (SEQ ID NO: 920) | GGCTATTGGTCA AGGCAAGG (SEQ ID NO: 930) | Antisense |
| Sp36 | CAAGGCUAUU GGUCAAGGCA (SEQ ID NO: 338) | CAAGGCTATTGG TCAAGGCA (SEQ ID NO: 911) | CAAGGCUAUUGG UCAAGGCAAGG (SEQ ID NO: 921) | CAAGGCTATTGG TCAAGGCAAGG (SEQ ID NO: 931) | Antisense |
| Sp40 | UGCCUUGUCA AGGCUAU (SEQ ID NO: 327) | TGCCTTGTCAAG GCTAT (SEQ ID NO: 912) | UGCCUUGUCAAGG CUAUUGG (SEQ ID NO: 922) | TGCCTTGTCAAG GCTATTGG (SEQ ID NO: 932) | Antisense |
| Sp42 | GUUUGCCUUG UCAAGGCUAU (SEQ ID NO: 299) | GTTTGCCTTGTC AAGGCTAT (SEQ IDNO: 913) | GUUUGCCUUGUCA AGGCUAUUGG (SEQ ID NO: 923) | GTTTGCCTTGTC AAGGCTATTGG (SEQ ID NO: 933) | Antisense |
| Sp38 | GACCAAUAGC CUUGACA (SEQ ID NO: 276) | GACCAATAGCCT TGACA (SEQ ID NO: 914) | GACCAAUAGCCUU GACAAGG (SEQ ID NO: 924) | GACCAATAGCCT TGACAAGG (SEQ ID NO: 934) | Sense |
| Sp37 | CUUGACCAAU AGCCUUGACA (SEQ ID NO: 333) | CTTGACCAATAG CCTTGACA (SEQ ID NO: 915) | CUUGACCAAUAGC CUUGACAAGG (SEQ ID NO: 925) | CTTGACCAATAG CCTTGACAAGG (SEQ ID NO: 935) | Sense |
| Sp43 | GUCAAGGCUA UUGGUCA (SEQ ID NO: 278) | GTCAAGGCTATT GGTCA (SEQ ID NO: 916) | GUCAAGGCUAUU GGUCAAGG (SEQ ID NO: 926) | GTCAAGGCTATT GGTCAAGG (SEQ ID NO: 936) | Antisense |
| Sp35 | CUUGUCAAGG CUAUUGGUCA (SEQ ID NO: 339) | CTTGTCAAGGCT ATTGGTCA (SEQ ID NO: 917) | CUUGUCAAGGCUA UUGGUCAAGG (SEQ ID NO: 927) | CTTGTCAAGGCT ATTGGTCAAGG (SEQ ID NO: 937) | Antisense |
| Sp41 | UCAAGUUUGC CUUGUCA (SEQ ID NO: 310) | TCAAGTTTGCCT TGTCA (SEQ ID NO: 918) | UCAAGUUUGCCUU GUCAAGG (SEQ ID NO: 928) | TCAAGTTTGCCT TGTCAAGG (SEQ ID NO: 938) | Antisense |
| Sp34 | UGGUCAAGUU UGCCUUGUCA (SEQ ID NO: 340) | TGGTCAAGTTTG CCTTGTCA (SEQ ID NO: 919) | UGGUCAAGUUUG CCUUGUCAAGG (SEQ ID NO: 929) | TGGTCAAGTTTG CCTTGTCAAGG (SEQ ID NO: 939) | Antisense |
| Sp85 | AGUAUCCAGU GAGGCCA (SEQ ID NO: 940) | AGTATCCAGTGA GGCCA (SEQ ID NO: 943) | AGUAUCCAGUGA GGCCAGGG (SEQ ID NO: 946) | AGTATCCAGTGA GGCCAGGG (SEQ ID NO: 949) | Antisense |
| SpA | GGCAAGGCUG GCCAACCCAU (SEQ ID NO: 941) | GGCAAGGCTGG CCAACCCAT (SEQ ID NO: 944) | GGCAAGGCUGGCC AACCCAUGGG (SEQ ID NO: 947) | GGCAAGGCTGG CCAACCCATGGG (SEQ ID NO: 950) | Sense |
| SpB | UAUUUGCAUU GAGAUAGUGU (SEQ ID NO: 942) | TATTTGCATTGA GATAGTGT (SEQ ID NO: 945) | UAUUUGCAUUGA GAUAGUGUGGG (SEQ ID NO: 948) | TATTTGCATTGA GATAGTGTGGG (SEQ ID NO: 951) | Sense |

Figure 4B:
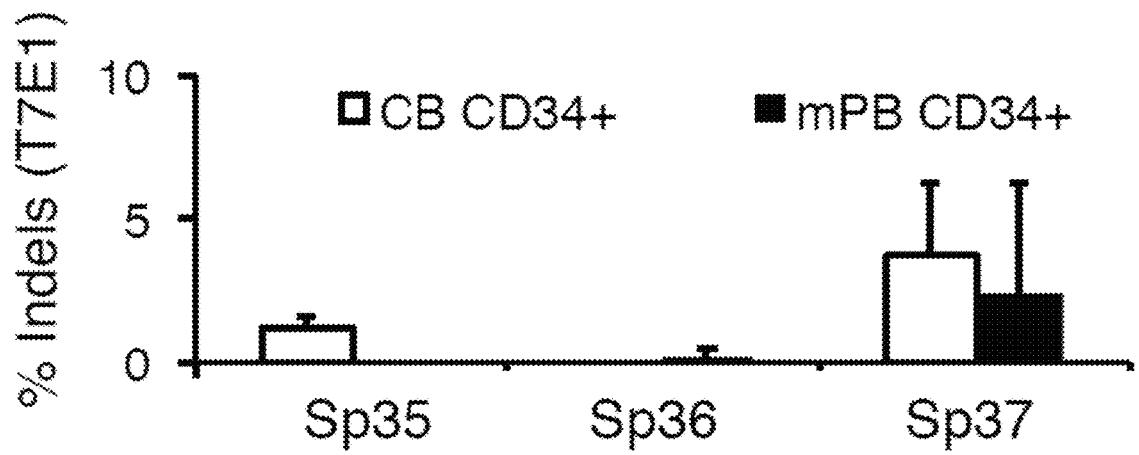

The HBG1 and HBG2 PCR products for the K562 cells that were targeted with the eight active sgRNAs were then analyzed by DNA sequencing analysis and scored for insertions and deletions detected. The deletions were subdivided into precise 13 nt deletions at the target site, 13 nt target site inclusive and proximal small deletions (18-26 nt), 12 nt deletions (i.e., partial deletion) of the 13 nt target site, >26 nt deletions that span a portion of the HPFH target site, and other deletions, e.g., deletions proximal to but outside the HPFH target site. Seven of the eight sgRNAs targeted Next, three *S. pyogenes* gRNAs whose target sites are within the HBG promoter (Sp35, Sp36, Sp37) were complexed to wild-type *S. pyogenes* Cas9 protein to form ribonucleoprotein complexes. These HBG targeted RNPS were electroporated into CB CD34+ cells (n=3 donors) and adult mobilized peripheral blood (mPB) CD34+ cell donors (n=3 donors). Then the level of insertions/deletions at the target site was analyzed by T7E1 endonuclease analysis of the HBG2 PCR products amplified from genomic DNA extracted from the samples approximately 3 days after Cas9 RNP delivery. Each of these RNPs supported only low level gene editing in both the CB and adult CD34+ cells across 3 donors and 3 separate experiments (FIG. 4B).

Figure 4C:
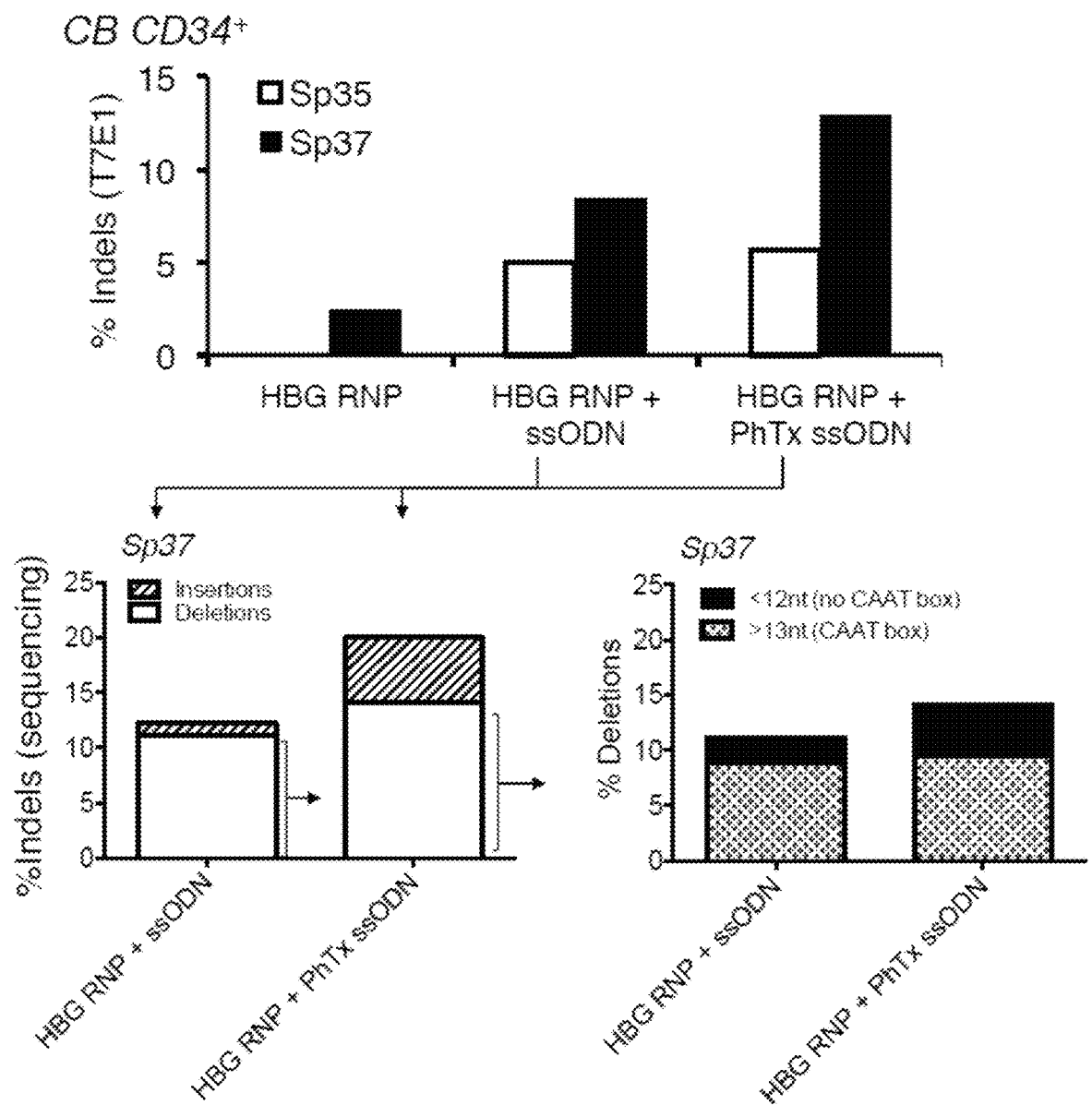

To increase gene editing and the occurrence of the 13 nt deletion at the target site, single strand deoxynucleotide donor repair templates (ssODNs) that encoded 87 nt and 89 nt of homology on each side of the targeted deletion site was generated. The ssODNs, either unmodified at the ends (i.e., ssODN1, SEQ ID NO:906, Table 8) or modified to contain phosphorothioates (PhTx) at the 5' and 3' ends (i.e., PhTx ssODN1, SEQ ID NO:909, Table 8). The ssODN was designed to 'encode' the 13 nt deletion with sequence homology arms engineered flanking this absent sequence to create a perfect deletion.

proximal promoter), the absence of which is associated with elevation of HbF expression (FIG. 4C, lower right panel). The remaining 4 of deletions were partial deletions that did not span the full 13 nt deletion. These data indicate that co-delivery of a homologous ssODN that is engineered to have a deletion supported precise gene editing (deletion) at HBG in human CD34+ cells.

Example 3: Cas9 RNP Targeting the 13 nt Deletion Mutation Supports Gene Editing Inhuman Adult Mobilized Peripheral Blood Hematopoietic Stem/Progenitor Cells with Increased HBG Expression in Erythroblast Progeny To determine whether editing HBG with Cas9 RNP complexed to Sp37 gRNA or Sp35 gRNA (i.e., the gRNAs that target the 13 nt deletion that is associated with HPFH) in the promoter of HBG supports an increase in HBG expression in erythroid progeny of edited CD34+ cells, human adult CD34+ cells from mobilized peripheral blood (mPB) were electroporated with the RNPs. Briefly, mPB CD34+ cells were prestimulated for 2 days with human cytokines and PGE2 in StemSpan SFEM and then electroporated with Cas9 protein precomplexed to Sp35 and Sp37,

TABLE 8

Single strand deoxynucleotide donor repair templates (ssODN)

| ssODN ID | SEQ ID NO | Sequence |
|---|---|---|
| ssODN1 5' homology arm | 904 | GGGTGCTTCCTTTTATTCTTCATCCCTAGCCAGCCGCCGGCCCCTG GCCTCACTGGATACTCTAAGACTATTGGTCAAGTTTGCCTT |
| ssODN1 3' homology arm | 905 | GTCAAGGCAAGGCTGGCCAACCCATGGGTGGAGTTTAGCCAGGGACCG TTTCAGACAGATATTTGCATTGAGATAGTGTGGGGAAGGGG |
| ssODN1 | 906 | GGGTGCTTCCTTTTATTCTTCATCCCTAGCCAGCCGCCGGCCCCTG GCCTCACTGGATACTCTAAGACTATTGGTCAAGTTTGCCTTGTCAAG GCAAGGCTGGCCAACCCATGGGTGGAGTTTAGCCAGGGACCGTTTCAG ACAGATATTTGCATTGAGATAGTGTGGGGAAGGGG |
| PhTx ssODN1 5' homology arm | 907 | G*GGTGCTTCCTTTTATTCTTCATCCCTAGCCAGCCGCCGGCCCCTG GCCTCACTGGATACTCTAAGACTATTGGTCAAGTTTGCCTT |
| PhTx ssODN1 3' homology arm | 908 | GTCAAGGCAAGGCTGGCCAACCCATGGGTGGAGTTTAGCCAGGGACCG TTTCAGACAGATATTTGCATTGAGATAGTGTGGGGAAGGG*G |
| PhTx ssODN1 | 909 | G*GGTGCTTCCTTTTATTCTTCATCCCTAGCCAGCCGCCGGCCCCTG GCCTCACTGGATACTCTAAGACTATTGGTCAAGTTTGCCTTGTCAAG GCAAGGCTGGCCAACCCATGGGTGGAGTTTAGCCAGGGACCGTTTCAG ACAGATATTTGCATTGAGATAGTGTGGGGAAGGG*G |

Figure 5A:
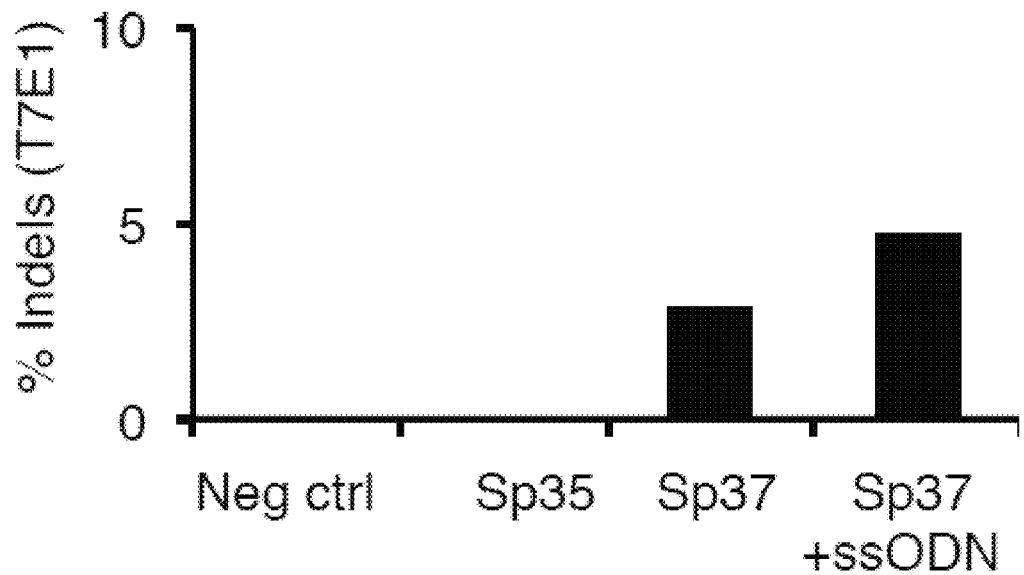
FIGS. 5A-B depict gene editing of HBG in adult human mobilized peripheral blood (mPB) CD34+ cells and induction of fetal hemoglobin in erythroid progeny of RNP treated cells after electroporation of mPB CD34+ cells with HBG Sp37 RNP+/−ssODN encoding the 13 nt deletion.

The homology arms flanking the deletion are indicated by bold [5' homology arm] and underline [3' homology arm]). Note the absence of the 13 bp sequence in ssODN1 and PhTx ssODN1.
*Represents modification by phosphorothioate.

ssODN1 and PhTx ssODN1 were co-delivered with RNP targeting HBG containing the Sp37 gRNA (HBG Sp37 RNP) or HBG Sp35 (HBG Sp35 RNP) to CB CD34+ cells. Co-delivery of the ssODN donor encoding the 13 nt deletion with HBG Sp35 RNP or HBG Sp37 RNP led to a 6-fold and 5-fold increase in gene editing of the target site, respectively, as determined by T7E1 analysis of the HBG2 PCR product (FIG. 4C). DNA sequencing analysis (Sanger sequencing) of the HBG2 PCR product indicated that 20% gene editing in cells that were treated with HBG Sp37 RNP and the PhTx modified ssODN1, with 15% deletions and 5% insertions (FIG. 4C, lower left panel). Further analysis of the specific type and size of deletions at the target site revealed that 75% of the total deletions detected contained the 13 nt deletion (which included deletion at c.-110 of the CAAT box in the respectively. T7E1 analysis of HBG PCR product indicated ~3% indels detected for mPB CD34+ cells treated with RNP complexed to Sp37 while no editing was detected for cells that were treated with RNP complexed to Sp35 (FIG. 5A).

Figure 5B:
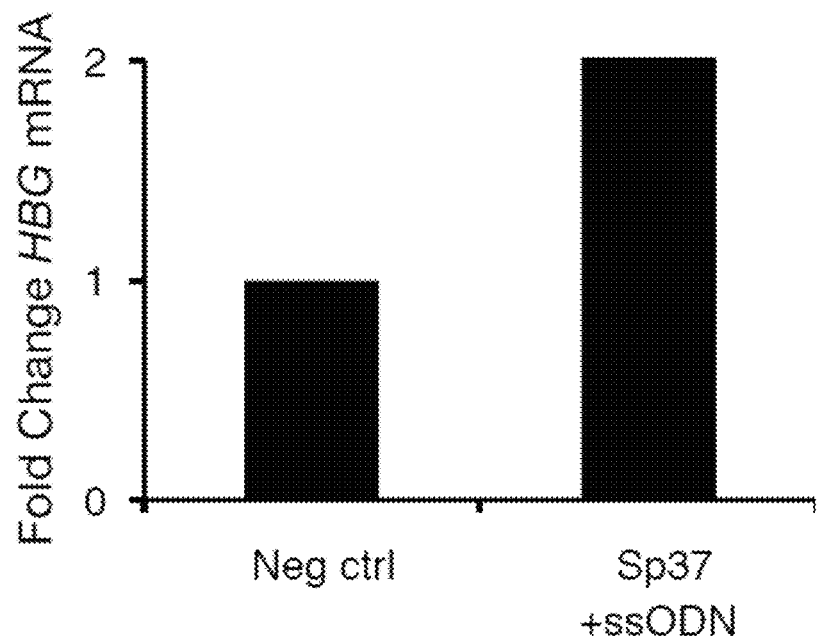
Figure 6A:
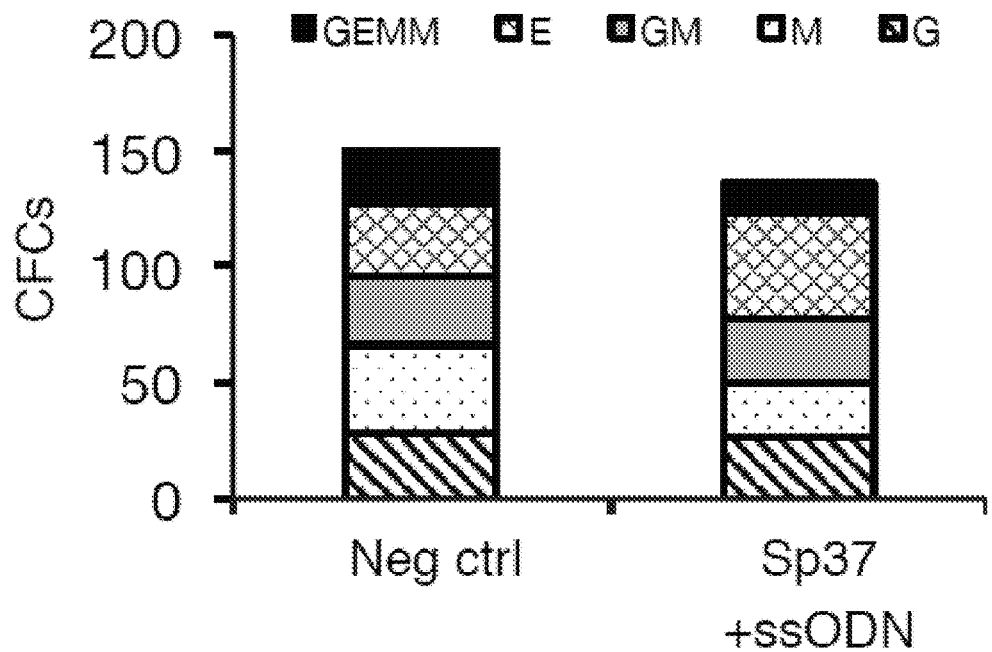
FIGS. 6A-B depict the ex vivo differentiation potential of RNP treated and untreated mPB CD34+ cells from the same donor.
Figure 6B:
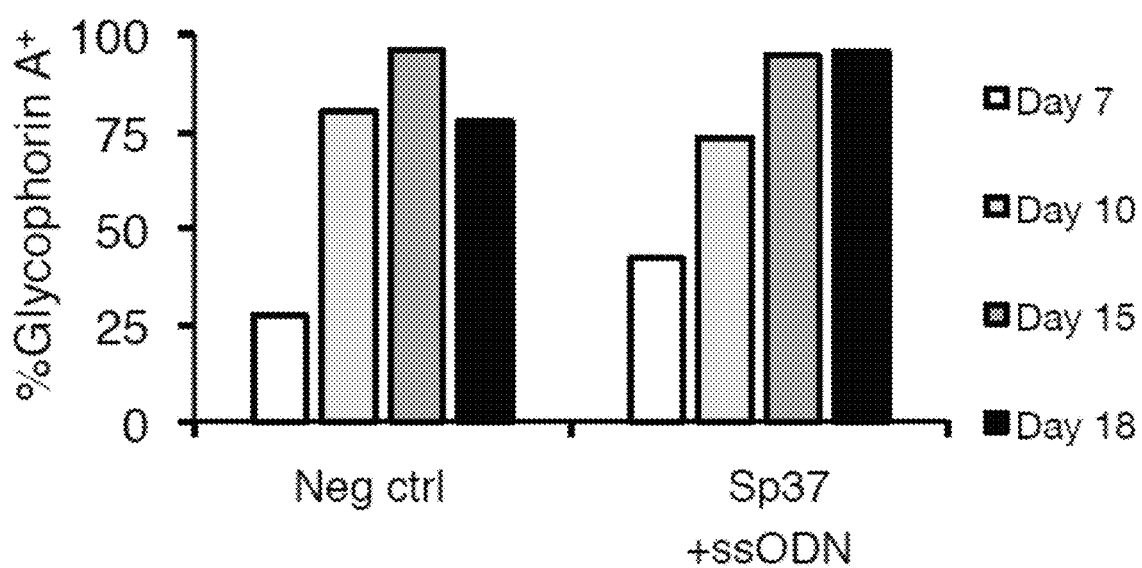

In order to increase gene editing at the target site and to increase the occurrence of the 13 nt deletion at the target site, PhTx ssODN1 (SEQ ID NO:909) was co-delivered with the precomplexed RNP targeting HBG containing the Sp37 gRNA. Co-delivery of the ssODN donor encoding the 13 nt deletion led to a nearly 2-fold increase in gene editing of the target site (FIG. 5A). To determine whether editing HBG increases production of fetal hemoglobin in erythroid progeny of edited adult CD34+ cells, the cells were differentiated into erythroblasts by culture for up to 18 days in the presence of human cytokines (erythropoietin, SCF, IL3), human plasma (Octoplas), and other supplements (hydrocortisone, heparin, transferrin). Over the time course of differentiation, mRNA was collected to evaluate HBG gene expression in the erythroid progeny of RNP treated mPB CD34+ cells and donor matched negative (untreated) controls. By day 7 of differentiation, erythroblast progeny of human CD34+ cells that were treated with HBG Sp37 RNP and 13 nt deletion encoding ssODN (~5% indels detected in gDNA from the bulk cell population by T7E1 analysis) exhibited a 2-fold increase in HBG mRNA production (FIG. 5B). Importantly, CD34+ cells that were electroporated with HBG RNP maintained their ex vivo hematopoietic activity (i.e., no difference in the quantity or diversity of erythroid and myeloid colonies compared to untreated donor matched CD34+ cell negative control), as determined in hematopoietic colony forming cell (CFC) assays (FIG. 6A). Furthermore, the erythroblasts differentiated from RNP treated CD34+ cells maintained the kinetics of differentiation observed for donor matched untreated control cells as determined by flow analysis for acquisition of erythroid phenotype (% Glycophorin A+ cells) (FIG. 6B). These data indicate that targeted disruption of HBG1/HBG2 proximal promoter region supported an increase in HBG expression in erythroid progeny of RNP treated adult hematopoietic stem/progenitor cells without altering differentiation potential.

Figure 7A:
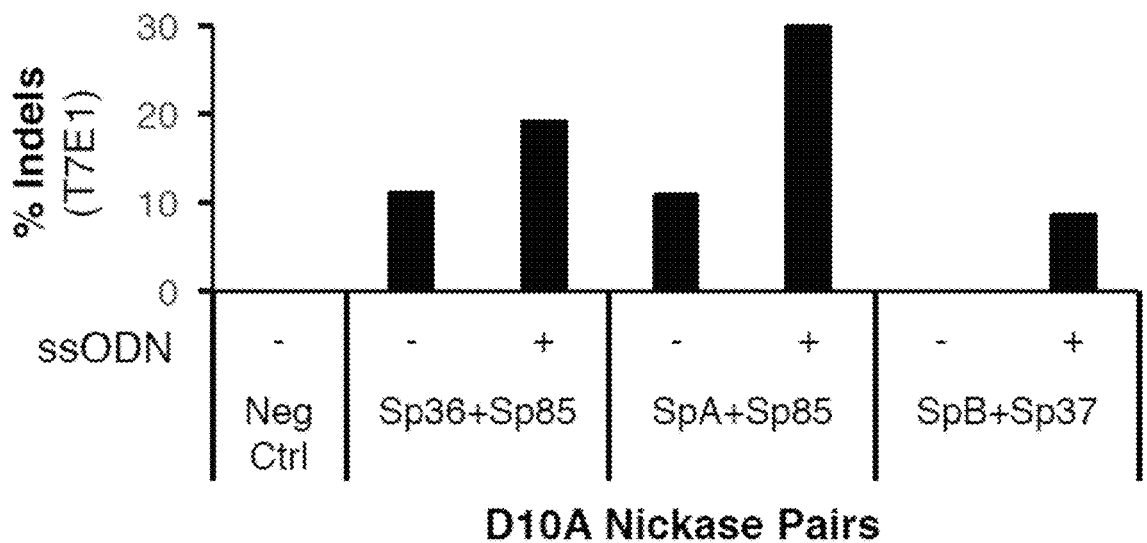
FIG. 7A depicts indels detected by T7E1 analysis of HBG PCR product amplified from gDNA extracted from human mPB CD34+ cells treated with HBG RNPs (D10A paired nickases). For a subset of samples, cells also received ssODN encoding the 13 nt deletion plus silent SNPs to monitor for HDR (ssODN).
Figure 7B:
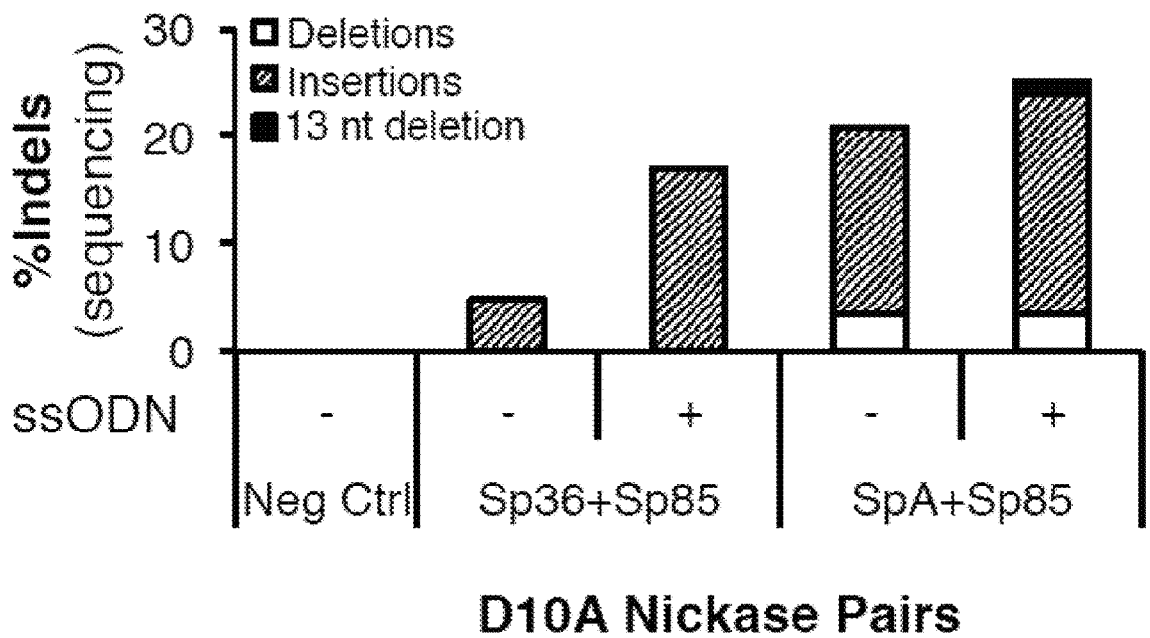
FIG. 7B depicts DNA sequencing analysis for select subset of samples shown in FIG. 7A. The indels were subdivided according to the type of indel (insertion, 13 nt deletion, or other deletion).

Example 4: Cas9 RNP Targeting the HPFH Mutation Supports Gene Editing in Human Adult Mobilized Peripheral Blood Hematopoietic Stem/Progenitor Cells with Increased HBG Expression in Erythroblast Progeny To determine whether co-delivery of paired nickase RNPs targeting HBG would increase targeted disruption of the proximal HBG promoter, mPB CD34+ cells were cultured for 2 days with human cytokines and PGE2 in StemSpan SFEM and then electroporated with S. pyogenes D10A Cas9 protein precomplexed to two gRNAs that target sites flanking the site of the 13 nt deletion. The targeting domain sequences for gRNAs used in nickase pairs in this example (including, without limitation, SpA, Sp85 and SpB) are presented in Table 7. D10A nickase pairs were selected such that the PAMs for the targets were oriented outward and the distance between the cut sites were <100 nt. gRNAs were complexed with D10A Cas9 protein to form RNP complexes and then human CD34+ cells and paired nickase were subject to electroporation. To determine whether co-delivery of an ssODN that encoded the 13 nt deletion would increase editing and introduction of the mutation into the cells, in some experiments, ssODN1 was added to the cell RNP mixture prior to electroporation. Approximately 3 days after electroporation, gDNA was extracted from the RNP treated cells and analyzed by T7E1 endonuclease assay and/or Sanger DNA sequencing of HBG2 PCR products amplified from the extracted gDNA. Of the three D10A nickase pairs tested, indels detected by T7E1 endonuclease analysis were increased for one nickase pair (gRNAs SpA+Sp85) samples for which ssODN1 was included (FIG. 7A). DNA sequencing analysis was performed on limited samples shown in FIG. 7A. DNA sequencing analysis showed up to ~27% indels at the target site, with insertions as the dominant indel detected, followed by deletions of the targeted region (area between the cut sites of the paired nickases), and the 13 nt deletion mutation was also detected at a frequency of 2-3% when ssODN1 encoding the deletion was co-delivered (FIG. 7B). Silent, non-pathogenic SNPs were included in the ssODN1 donor template, and were detected in the sequences that contained the 13 nt deletion, indicating that creation of the HFPH mutation occurred through an HDR event.

Figure 8A:
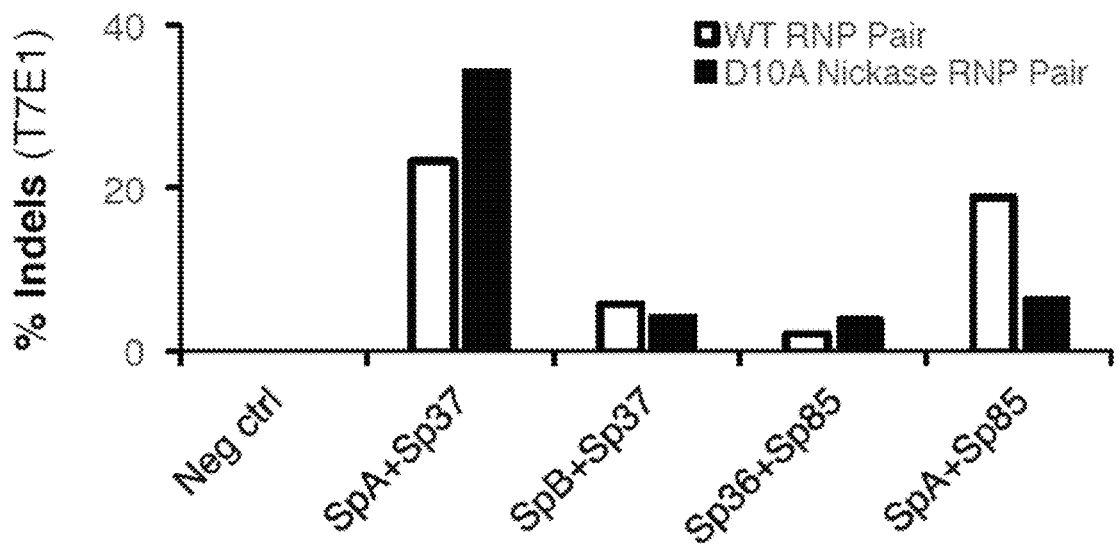
FIG. 8A depicts the indels at the HBG target site after electroporation of mPB CD34+ cells with the indicated pairs of gRNAs complexed in D10A nickase and WT RNP pairs.
Figure 8B:
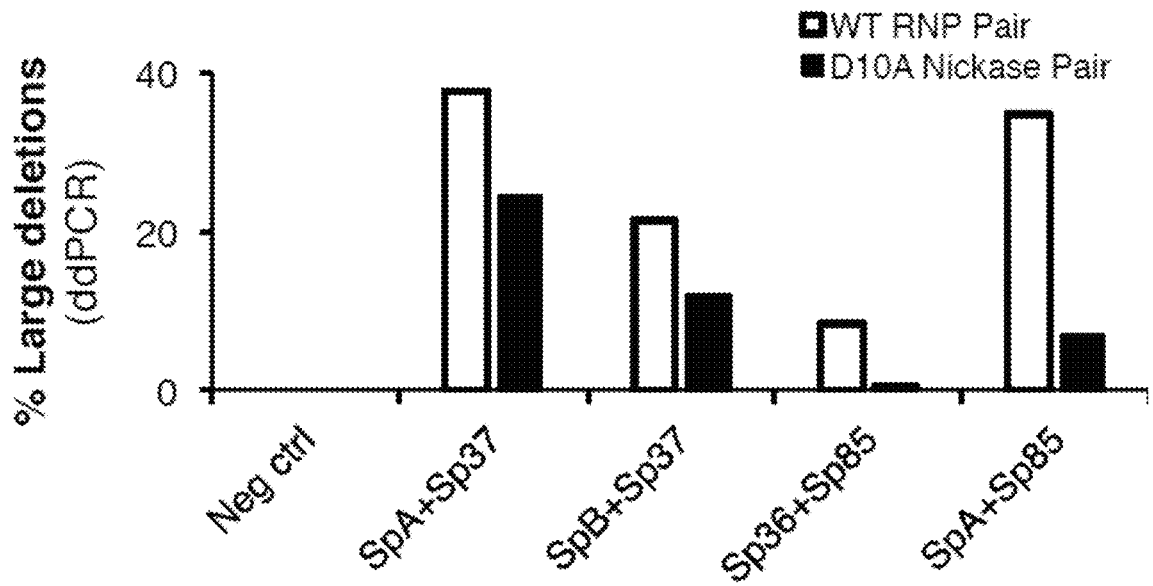
FIG. 8B depicts the large deletion events (e.g. deletion of HBG2) after electroporation of mPB CD34+ cells with the indicated pairs of gRNAs complexed in D10A nickase and WT RNPs.
Figure 8C:
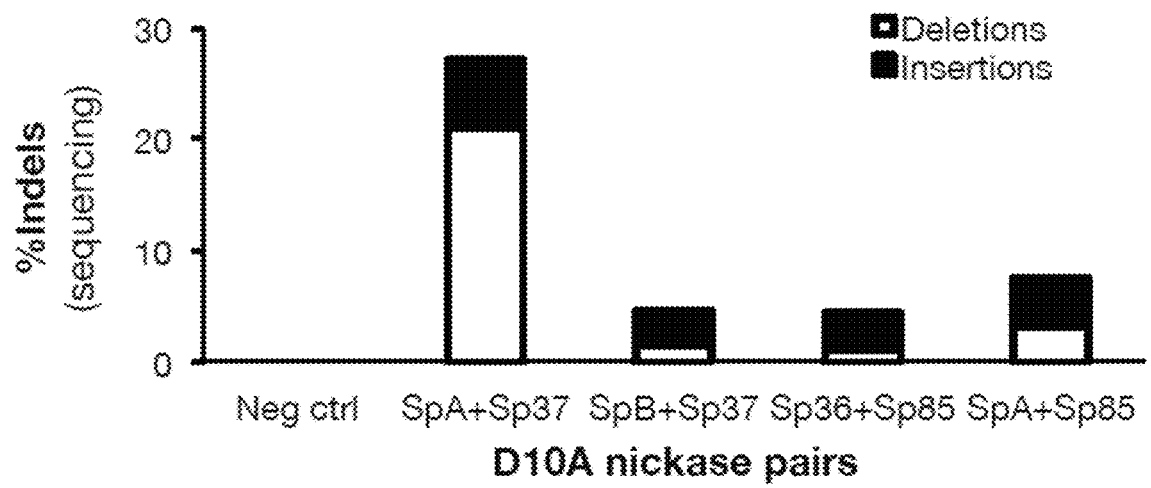
FIG. 8C depicts DNA sequencing analysis and the subtypes of events (insertions, deletions) detected in gDNA from mPB CD34+ cells treated with paired D10A nickase pairs.
Figure 8D:
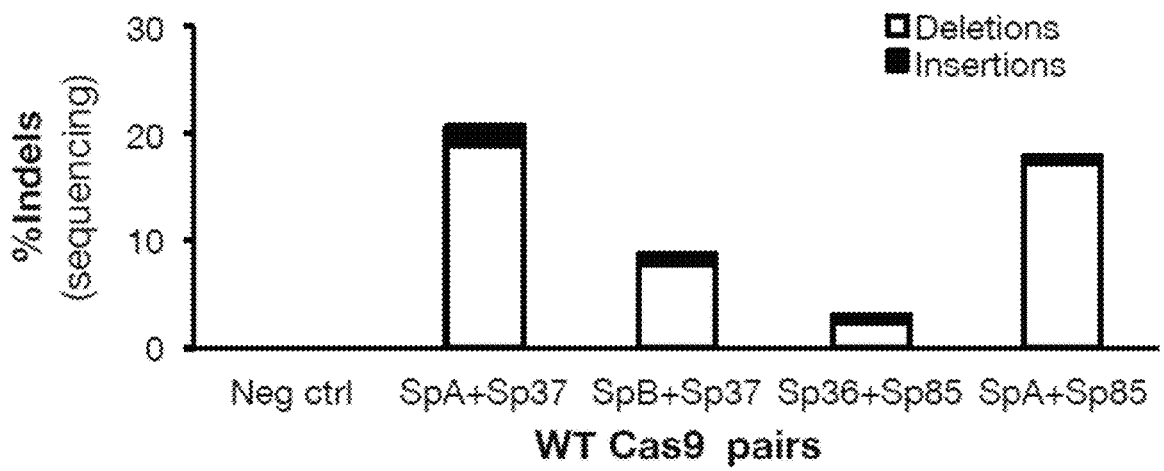
FIG. 8D depicts DNA sequencing analysis and the subtypes of events (insertions, deletions) detected in gDNA from mPB CD34+ cells treated with paired WT RNP pairs.

Example 5: D10A Paired RNPs Electroporated into Adult CD34+ Cells Supports Induction of HbF Protein in Erythroid Progeny To further optimize editing conditions in mPB CD34+ cells at the target site and to evaluate editing in additional human cell donors, human mPB CD34+ cells were electroporated with D10A Cas9 and WT Cas9 paired RNPs targeting HBG. The most efficient guide pair for both D10A Cas9 and WT Cas9 RNPs was Sp37+SpA, which supported >30% indels as determined by T7E1 endonuclease analysis of HBG2 PCR products (FIG. 8A). Given that editing at both HBG1 and HBG2 could result in large deletions of HBG2 and the intergenic region between HBG2 and HBG1, indels were further characterized in order to capture local indels by T7E1 endonuclease assay and sequencing and large deletion by ddPCR analysis. Large deletions were detected in all samples at variable frequencies for both D10A Cas9 and WT Cas9 RNP nickase pairs (FIG. 8B). Illumina sequencing analysis of indels correlated with indels determined by T7E1 analysis (FIG. 8C-8D).

To determine whether CD34+ cells edited with dual nickases at the HBG promoter gave rise to erythroid progeny with elevated HbF expression, donor matched RNP treated and untreated controls were induced toward erythroid differentiation and then evaluated for maintenance of indels during differentiation and for expression of HbF mRNA and protein. The level of editing (as determined by T7E1 endonuclease assay) was evaluated over the first 2 weeks of erythroid differentiation in the progeny of RNP treated cells prior to enucleation. Indels were detected in the erythroid progeny at every time point assayed suggesting that the editing that occurred in the CD34+ cells was maintained during erythroid differentiation and that edited CD34+ cells maintain erythroid differentiation potential.

Figure 9:
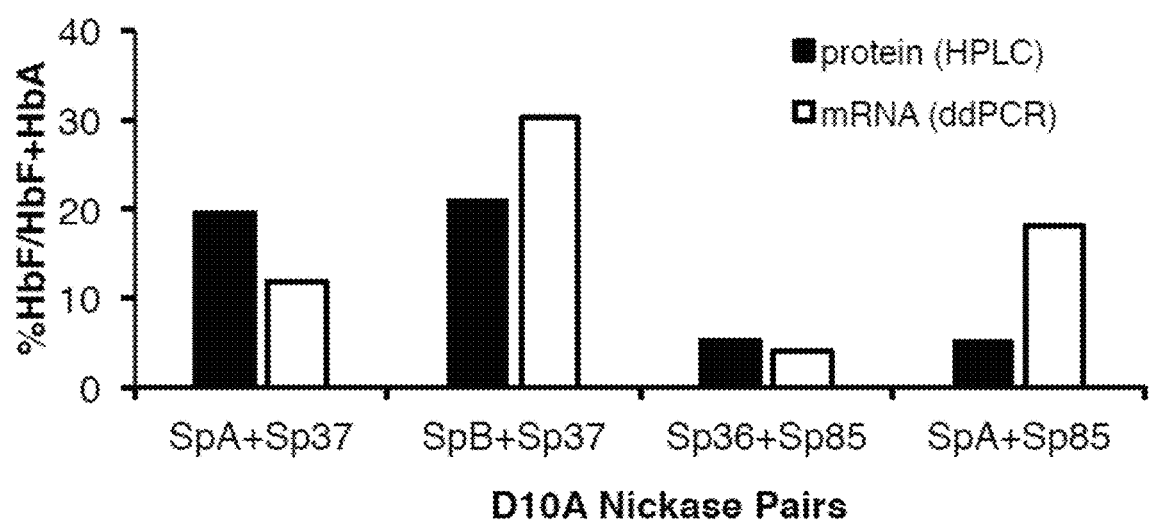
FIG. 9 depicts the summary of HbF protein and mRNA expression in the progeny of mPB CD34+ cells treated with paired RNPs targeting HBG, for the experiments shown in FIGS. 7 and 8. HbF protein (by HPLC analysis) and HbF mRNA expression (ddPCR analysis) were evaluated in erythroid progeny of RNP treated human mPB CD34+ cells (background levels of HbF detected in donor matched untreated controls were subtracted from the levels detected in progeny of RNP treated CD34+ cells).

The levels of HBG mRNA (day 10 of differentiation) and HbF protein (day 20-23 of differentiation) were quantified by ddPCR and HPLC analysis (according to the HPLC method described in Chang 2017 at pp. 143-44, incorporated by reference herein), respectively (FIG. 9). A ~2-fold increase (+40% in in HBG transcripts vs. unedited donor matched control) was observed for HBG:HBA ratio (data not shown) and the ratio of HbF/HbF+HbA (i.e. HBG mRNA HGB+HBB mRNA) increased to 30% above the level detected in donor matched untreated control samples.

For the D10A Cas9 nickase pairs, upregulation of HbF mRNA and protein was detected in erythroid progeny (FIG. 9). With respect to HbF protein analysis, two pairs supported 20% HbF induction for two D10A nickase pairs. No HbF upregulation was detected in erythroid progeny of WT Cas9 RNP treated CD34+ cells (data not shown).

Figure 10A:
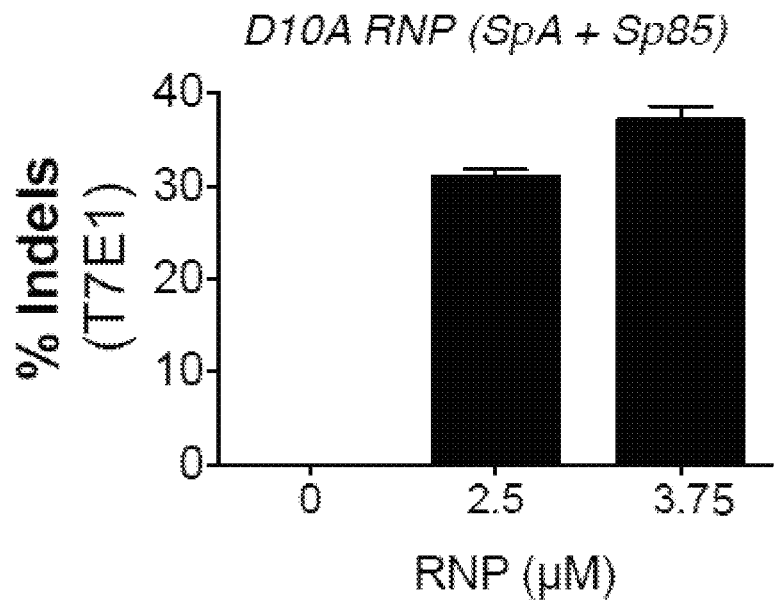
FIGS. 10A-H depict the indel frequencies and ex vivo and in vivo short-term hematopoietic potential of CD34+ cells after treatment with different concentrations (0, 2.5, 3.7 µM) of paired D10A nickase RNPs (SpA+Sp85). Indels were evaluated by T7E1 analysis (FIG. 10A) and by Illumina sequencing analysis (insertions and deletions, FIG. 10B).
Figure 10B:
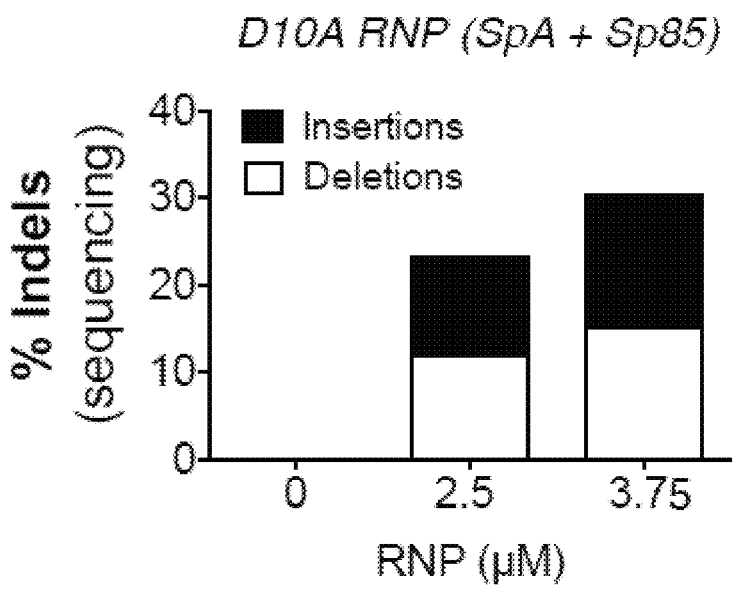
Figure 10C:
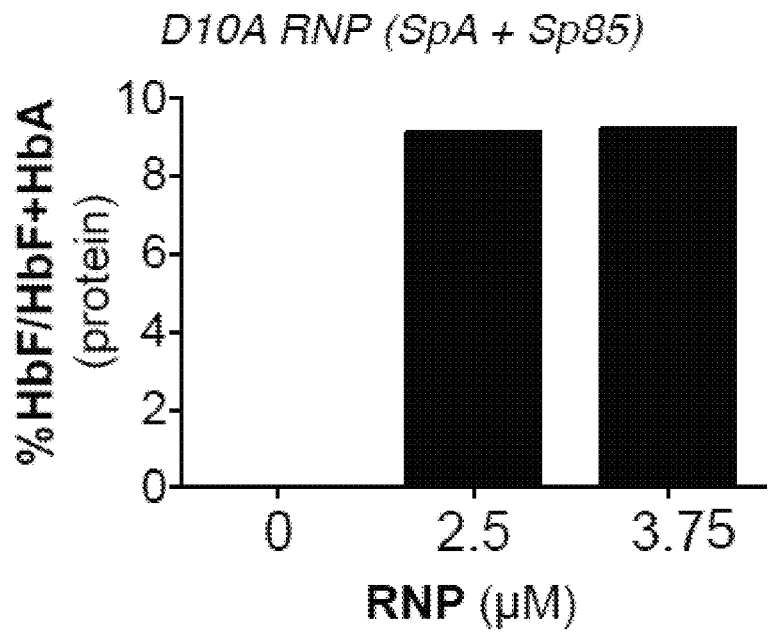
Figure 10D:
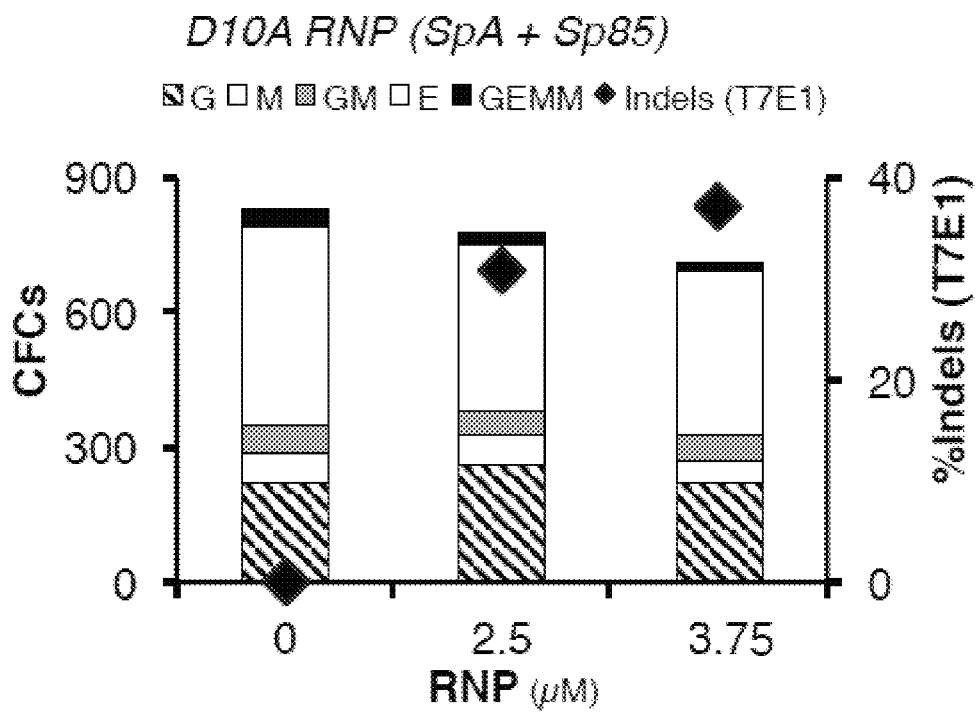
Figures 10E, 10F:
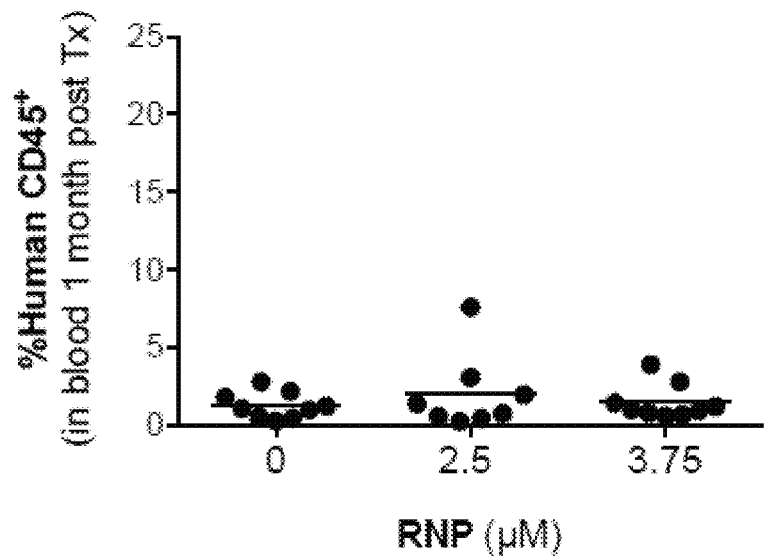
Figure 10G:
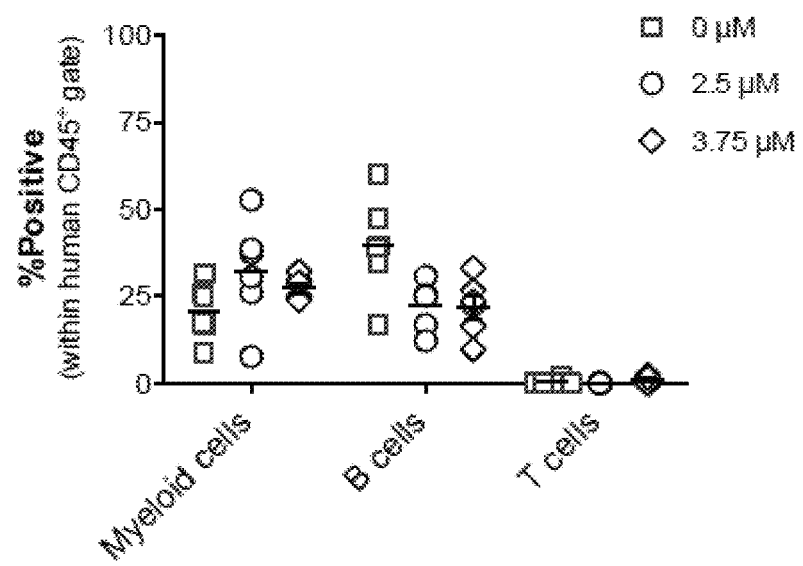
Figure 10H:
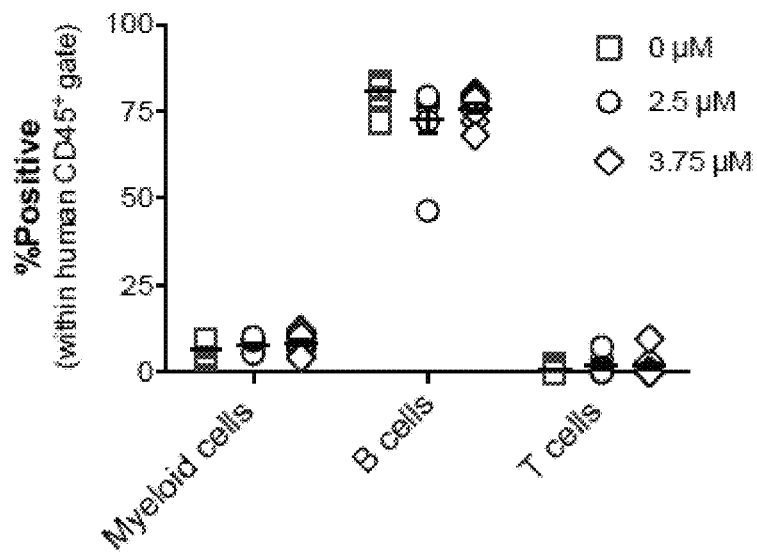

Example 6: Increasing the Dose of RNP Increases Total Editing Efficiency in Human Adult CD34+ Cells at the HBG Locus The concentration of D10A Cas9 RNP for the nickase pair SpA+Sp85 was increased (2.5 µM standard concentration and 3.7 µM) and delivered to mPB CD34+ cells by electroporation. The increased RNP concentration supported an increase in indels at the HBG target site to >30% (FIG. 10A) as determined by T7E1 endonuclease analysis of the HBG PCR product amplified for gDNA extracted 3 days after electroporation of CD34+ cells. Sequencing analysis indicated that increasing the RNP concentration increased insertions (FIG. 10B). Erythroid progeny of RNP treated CD34+ cells also had an increase in HbF protein production (FIG. 10C). Importantly, the hematopoietic colony forming potential was maintained after editing (FIG. 10D). These cells were then transplanted into immunodeficient mice and their engraftment 1 month (FIG. 10E) and 2 months (FIG. 10F) after transplantation was evaluated by sampling the peripheral blood and measuring the percentage of human CD45+ cells. Early engraftment data showed no difference in engraftment between recipient cohorts of donor matched untreated controls (0 µM RNP) and mice transplanted with RNP treated cells. Furthermore, there was no difference in human blood lineage distribution (myeloid, B cell, T cell) within the human CD45+ fraction among cohorts at indicated time points (FIG. 10G-H).

Figure 11A:
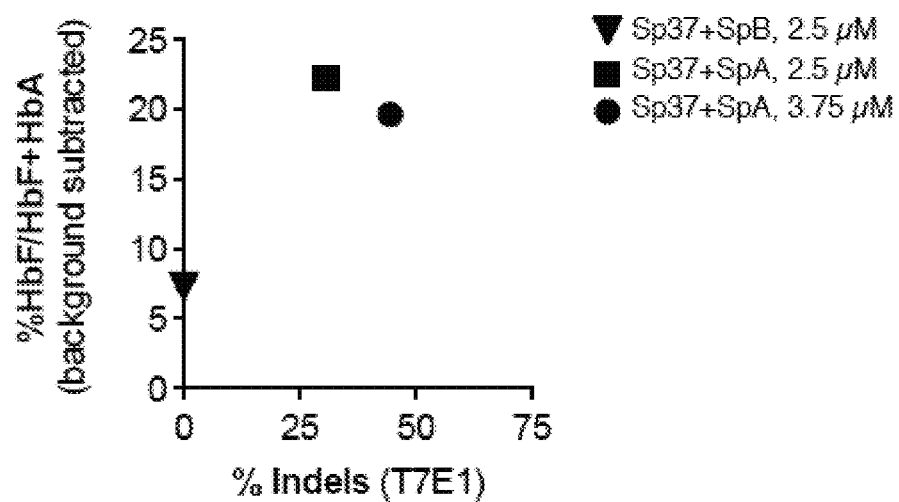
FIG. 11A correlates HbF levels as assayed by HPLC and indel frequency as assessed by T7E1 analysis for two D10A nickase RNP pairs (SP37+SPB and SP37+SPA) delivered at the indicated concentrations to mPB CD34+ cells. HbF levels were analyzed in erythroid progeny (day 18) of edited CD34+ cells. HbF protein detected in donor-matched untreated controls were subtracted from edited samples.
Figure 11B:
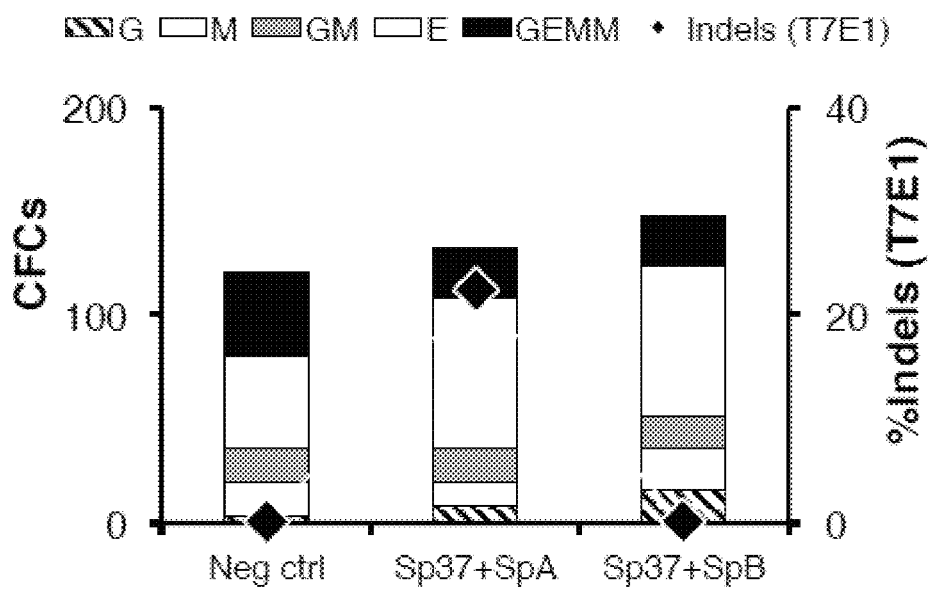
FIG. 11B depicts indel rates overlaid on hematopoietic colony forming cell (CFC) activity associated with CD34+ cells treated with the indicated D10A nickase pairs or untreated controls.
Figure 11C:
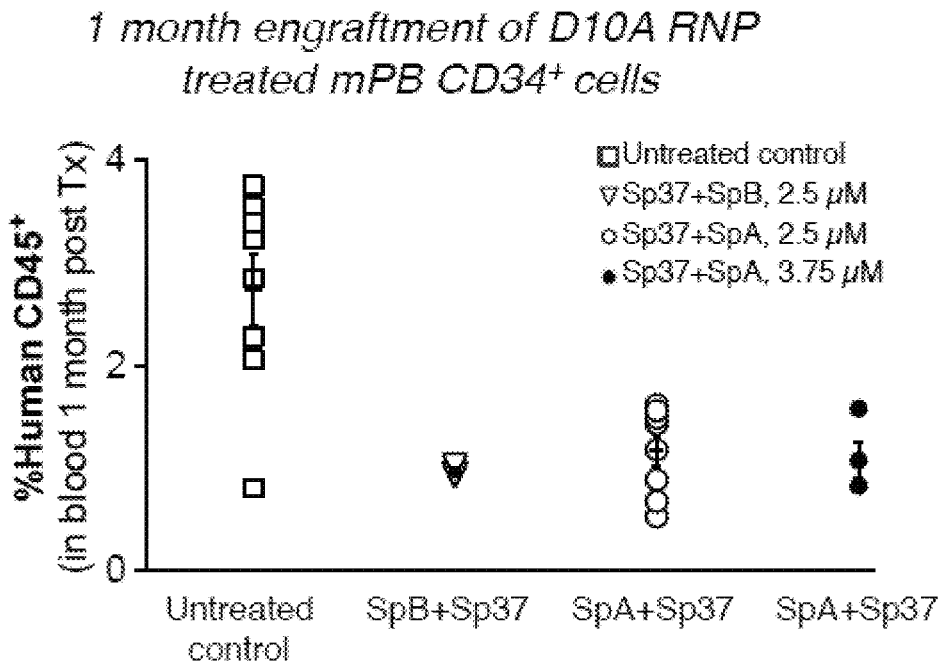
FIG. 11C depicts human CD45+ blood cell reconstitution of immunodeficient NSGmice one month after transplantation of mPB CD34+ cells treated with indicated D10 RNP nickase pairs at the concentrations given or donor matched untreated controls.
Figure 11D:
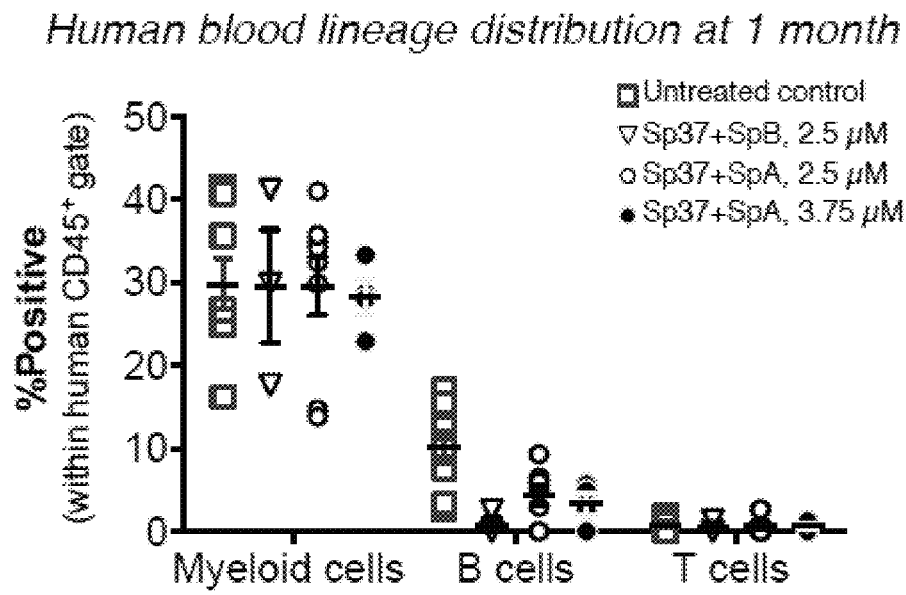
FIG. 11D depicts the human blood lineage distribution detected in the human CD45+ fraction in mouse peripheral blood one month post-transplant.
Figure 12:
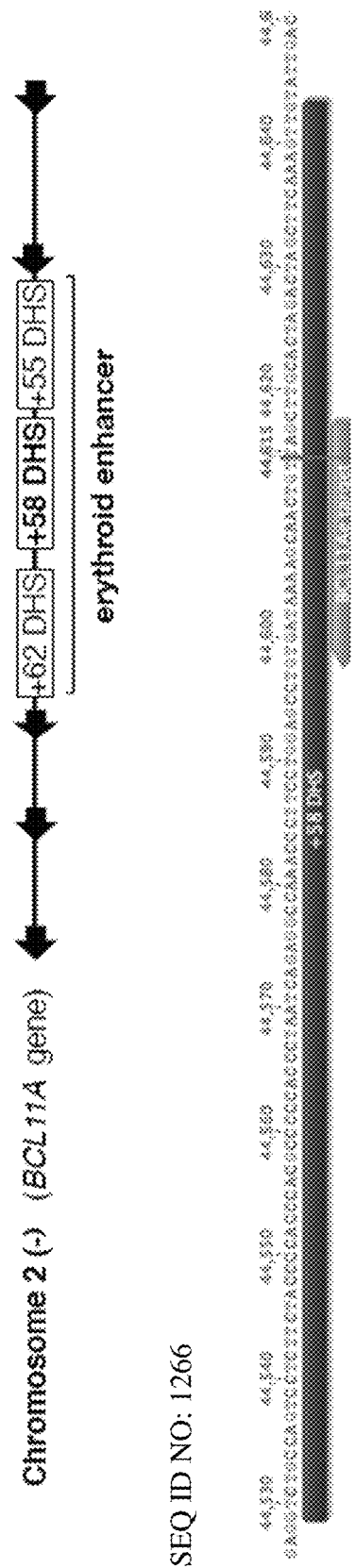
FIG. 12 depicts a target site for derepression of HbF, the GATA1 motif of the +58 DNase I hypersensitive site (DHS) erythroid specific enhancer of BCL11A (BCL11Ae) (genomic coordinates: chr2: 60,495,265 to 60,495,270).

Two additional D10A nickase pairs were also tested in RNP dose response studies in adult mPB CD34+ cells (Sp37+SpA, Sp37+SpB). Here, mPB CD34+ cells were electroporated with D10A paired nickases delivered at 0, 2.5, and 3.75 µM of total RNP. RNP treated cells were differentiated into erythroid progeny and the HbF protein levels (% HbF/HbF+HbA) were analyzed by HPLC analysis. The indel frequency detected in CD34+ cells was plotted with the HbF levels detected in erythroid progeny in order to correlate editing and HbF induction (FIG. 11A). RNP treated and untreated control mPB CD34+ cells were also differentiated into colonies to evaluate ex vivo hematopoietic activity. Colony forming cell (CFC) activity was maintained for the progeny of RNP treated and donor matched untreated control CD34+ cells (FIG. 11B). There was no difference in the percentage of human CD45+ cells in the mouse peripheral blood 1 month after transplantation and no difference in blood lineage distribution (FIG. 11C-D) for cells exposed to different D10A RNP pairs at different doses compared to untreated donor matched control CD34+ cells.

of a transcriptional repressor, BCL11A (Canvers 2015). One potential strategy to increase HbF expression through a gene editing strategy is to multiplex gene editing for introduction of 13 nt deletion associated in the HBG proximal promoter and also for targeted disruption of the GATA1 binding motif in the erythroid specific enhancer of BCL11A that is in the +58 DHS region of intron 2 of the BCL11A gene (FIG. 12). In order to accomplish this multiplex strategy to increase HbF expression through multiplex gene editing, the effect of disruption of BCL11A erythroid enhancer (BCL11Ae) must first be determined as a single editing event.

Figure 13A:
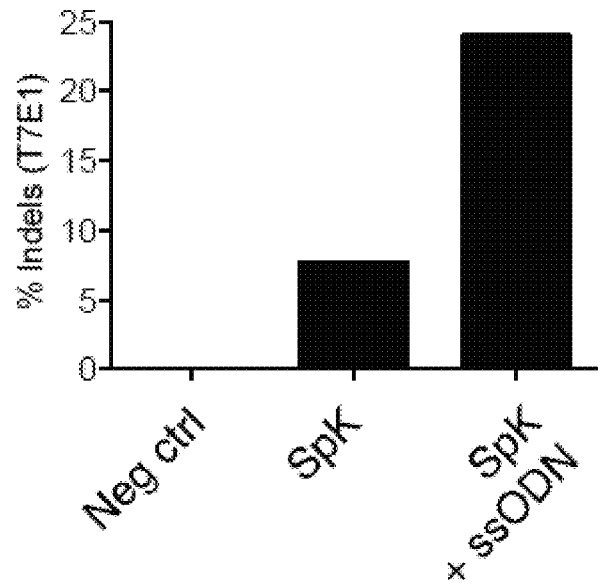
FIG. 13A depicts the percentage of indels detected by T7E1 endonuclease analysis of BCL11A PCR products amplified from gDNA extracted from CB CD34+ cells treated with the indicated RNP+/−ssODN or donor matched untreated control cells. Data shown represent the mean of three 3 separate donors/experiments.
Figure 13B:
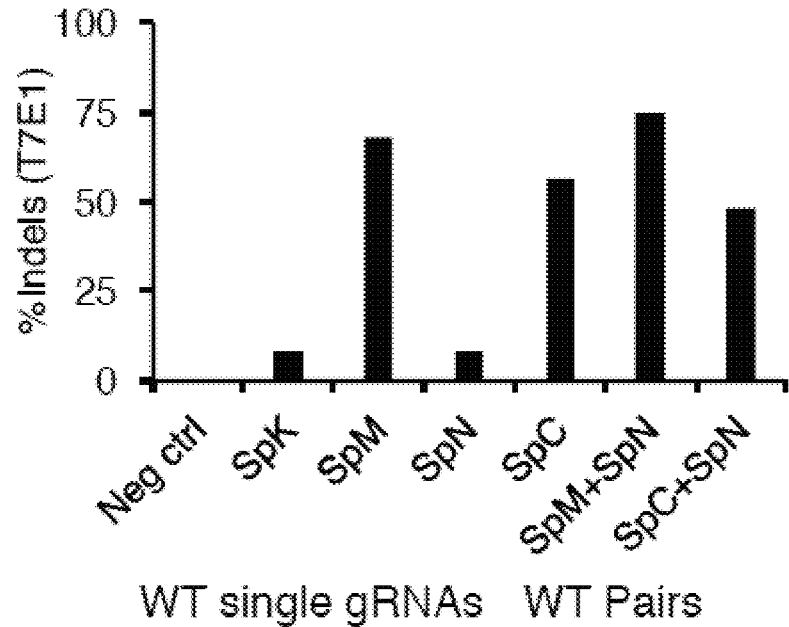
FIG. 13B depicts indels detected by T7E1 endonuclease analysis of BCL11A PCR products amplified from gDNA extracted from CB CD34+ cells treated with the indicated WT RNP (single gRNA targeting the BCL11A erythroid enhancer complexed to WT S. pyogenes Cas9 having both RuvC and HNH activity) or paired nickase RNP (paired gRNAs targeting the BCL11A erythroid enhancer complexed to S. pyogenes Cas9 nickases sharing the same HNH single stranded cutting activity (e.g. D10A), as well as the hematopoietic activity of cells in each condition.

In this experiment, CB CD34+ cells were electroporated with S. pyogenes WT Cas9 complexed to in vitro transcribed sgRNA targeting the GATA1 motif in the +58 DHS region of intron 2 of BCL11A gene (gRNA SpK, Table 9) (FIG. 13A). To determine whether co-delivery of a non-target specific ssODN would increase editing of the target sequence, BCL11Ae RNP was co-delivered with ssODN (which is nonhomologous to the BCL11Ae target sequence) in CB CD34+ cells. T7E1 analysis of BCL11A erythroid enhancer PCR product from gDNA extracted from CB CD34+ cells treated with BCL11Ae RNP indicated that ~5% indels was achieved (FIG. 13A). Co-delivery of BCL11Ae RNP with a non-target specific ssODN increase in indels by 5-fold to 20% as detected by T7E1 endonuclease analysis. Illumina sequencing analysis indicated that >90% of edits had disruption of the GATA1 motif in the +DHS 58 region enhancer in intron 2 of the BCL11A gene (data not shown). To increase editing, human CB CD34+ cells were electroporated with WT Cas9 RNP (single gRNAs complexed to WT Cas9) or with WT Cas9 paired RNPs (paired gRNAs complexed to WT Cas9), so that the cut sites in each pair flank the target site for excision of the GATA1 motif (gRNAs SpC, SpK, SpM, SpN) (Table 9). Two of the single gRNAs and two pairs had >50% indels as determined by T7E1 endonuclease analysis (FIG. 13B).

TABLE 9

Select gRNA sequences targeting BCL11A erythroid enhancer for screening in CD34+ cells

| gRNA ID | Targeting domain sequence (RNA) | Targeting domain sequence (DNA) | Targeting domain sequence plus PAM (NGG) (RNA) | Targeting domain sequence plus PAM (NGG) (DNA) | Sense |
|---|---|---|---|---|---|
| SpK | CUAACAGUUG CUUUUAUCAC (SEQ ID NO: 952) | CTAACAGTTGC TTTTATCAC (SEQ ID NO: 956) | CUAACAGUUGCU UUUAUCACAGG (SEQ ID NO: 960) | CTAACAGTTGCT TTTATCACAGG (SEQ ID NO: 964) | Antisense |
| SpM | GGGCGUGGGU GGGGUAGAAG (SEQ ID NO: 953) | GGGCGTGGGT GGGGTAGAAG (SEQ ID NO: 957) | GGGCGUGGGUGG GGUAGAAGAGG (SEQ ID NO: 961) | GGGCGTGGGTGG GGTAGAAGAGG (SEQ ID NO: 965) | Antisense |
| SpN | CUCUUAGACA UAACACACCA (SEQ ID NO: 954) | CTCTTAGACAT AACACACCA (SEQ ID NO: 958) | CUCUUAGACAUA ACACACCAGGG (SEQ ID NO: 962) | CTCTTAGACATA ACACACCAGGG (SEQ ID NO: 966) | Antisense |
| SpC | AUCAGAGGCC AAACCCUUCC (SEQ ID NO: 955) | ATCAGAGGCC AAACCCTTCC (SEQ ID NO: 959) | AUCAGAGGCCAA ACCCUUCCUGG (SEQ ID NO: 963) | ATCAGAGGCCAA ACCCTTCCTGG (SEQ ID NO: 967) | Sense |

Figure 14A:
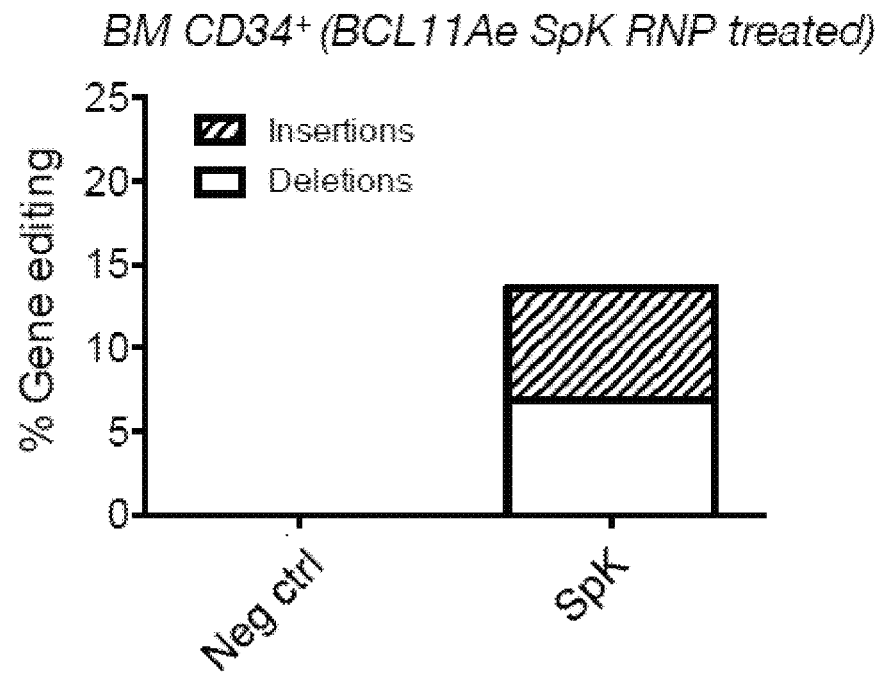
FIG. 14A depicts the editing frequency of BCL11Ae (using single gRNA approach targeting the GATA1 motif) in adult human BM CD34+ cells.
Figure 14B:
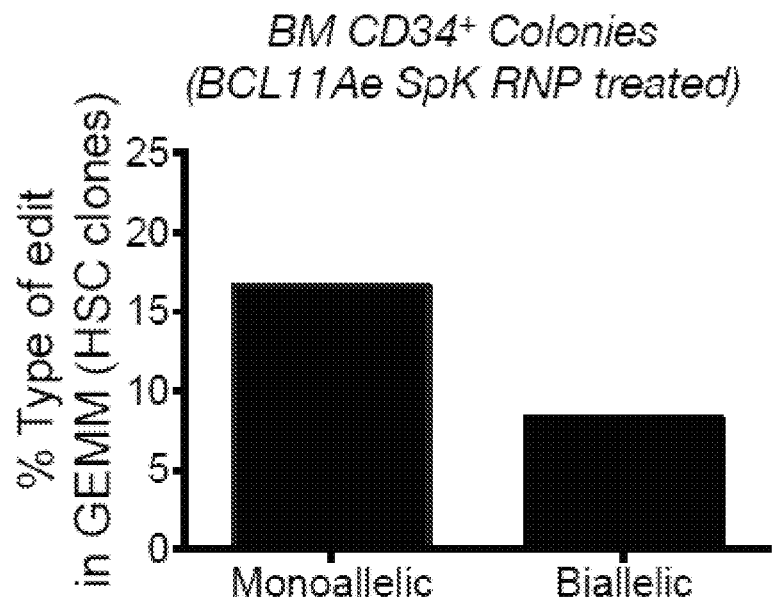
FIG. 14B depicts the monoallelic and bialleleic editing detected in hematopoietic colonies (GEMMs, clonal progeny of BCL11Ae RNP treated CD34+ cells) as determined by DNA sequencing analysis.
Figure 14C:
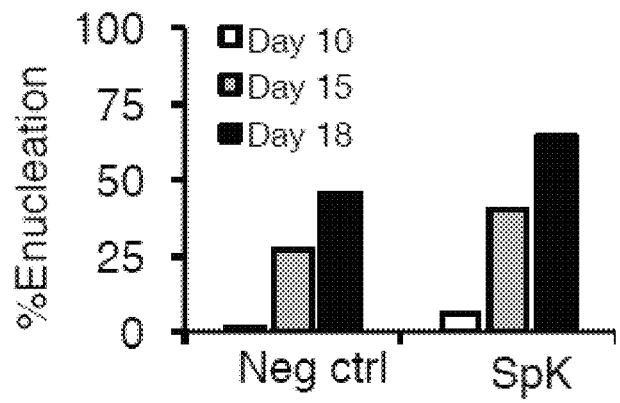
FIG. 14C depicts the kinetics of erythroblast maturation (enucleation as determined by DRAQ5− cells detected by flow cytometry analysis).
Figure 14D:
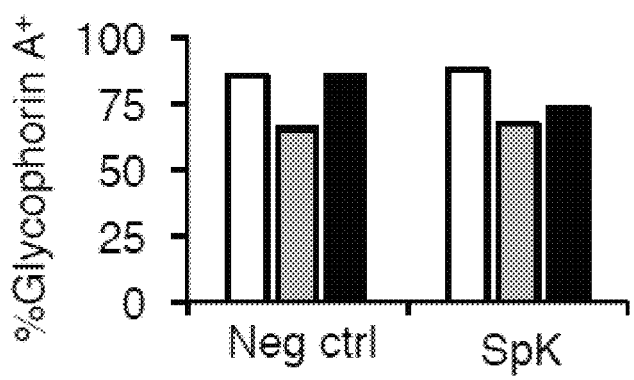
Figure 14E:
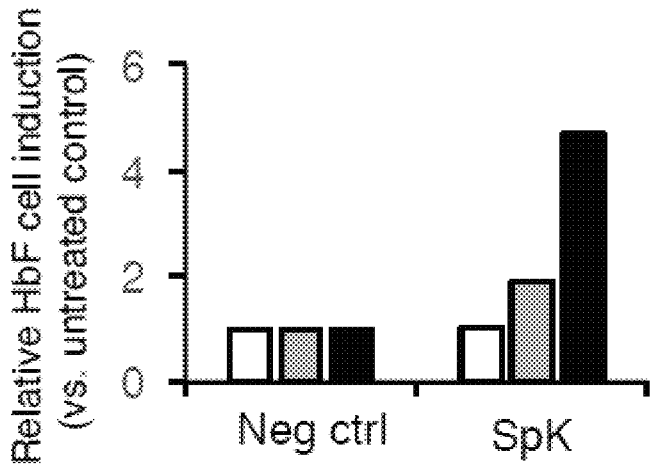
FIG. 14E shows the fold increase in HbF+ cells as determined by flow cytometry analysis relative to HbF+ cells in untreated donor matched control samples.

Example 7: Co-Delivery of RNP Targeting the Erythroid Specific Enhancer of BCL11A and a Non-Specific (N) Single Strand Deoxynucleotide Sequence or Paired RNPs Increases Gene Editing in Human CD34+ Cells and Supports Induction of Fetal Hemoglobin Expression in Erythroid Progeny Fetal hemoglobin expression can be induced through targeted disruption of the erythroid cell specific expression Next, human adult one marrow D34+ cells were electroporated with the BCL11Ae RNP. DNA sequencing analysis of the BCL11A PCR product amplified from gDNA extracted from marrow CD34+ cells indicated 15% gene editing comprised of insertions and deletions (FIG. 14A). Importantly, all deletions resulted in deletion of the GATA1 motif and all insertions disrupted GATA1 motif through addition of a small number of bp in the motif. CD34+ cells were plated into colony forming assays and the mixed hematopoietic colonies (GEMMs), which correspond to CD34+ cell clones, were picked. gDNA was isolated and analyzed by Illumina sequencing to quantify monoallelic and biallelic disruption of the target site. Most GEMMs differentiated from the CD34+ cell clones had monoallelic disruption and biallelic disruption was also detected, with the overall indel rate ~2/3 higher compared to what was detected in the bulk CD34+ cell population (FIG. 14B). This was likely a reflection of the percentage of common myeloid progenitors (CMPs) that give rise to GEMMs that make up a larger fraction of the heterogenous CD34+ cells versus the other lineages present, but not captured/differentiated in the short-term CFC assays. The RNP treated marrow CD34+ cells also maintained similar kinetics of erythroid maturation (enucleation, FIG. 14C) and differentiation (phenotype acquisition, FIG. 14D) compared to donor matched untreated control cells. Erythroid progeny of edited marrow CD34+ cells exhibited ~5-fold increase in HbF induction as determined by flow cytometry analysis (FIG. 14E).

Figure 15A:
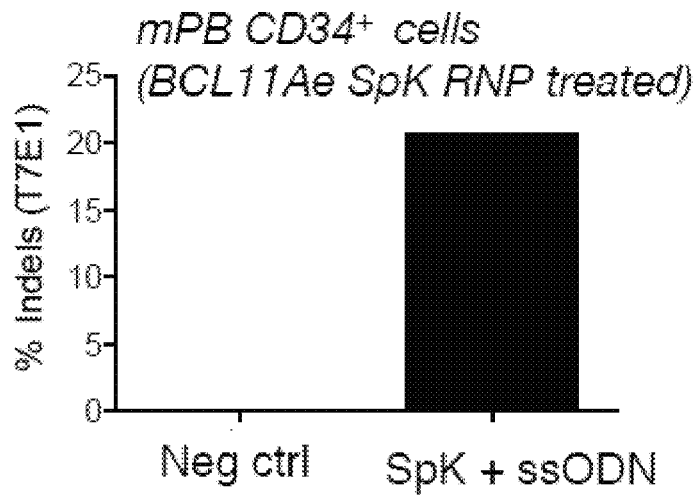
FIGS. 15A-C depict gene editing of BCL11Ae in adult human mPB CD34+ cells and induction of fetal hemoglobin in erythroid progeny of RNP and ssODN treated cells after electroporation of mPB CD34+ cells with BCL11Ae RNP+ nonspecific ssODN.
Figure 15B:
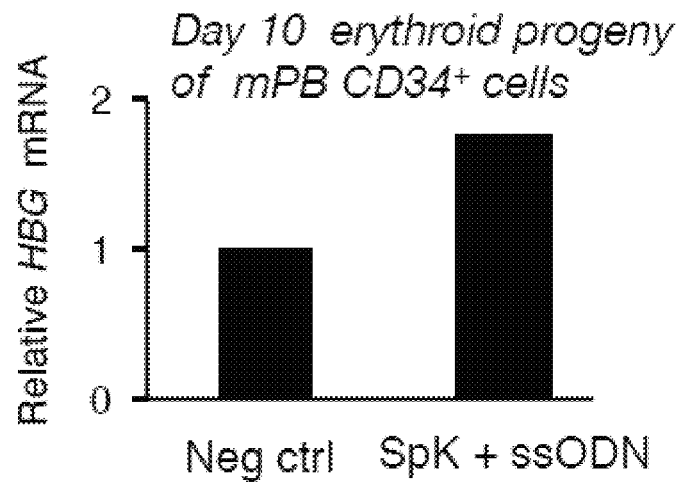
Figure 15C:
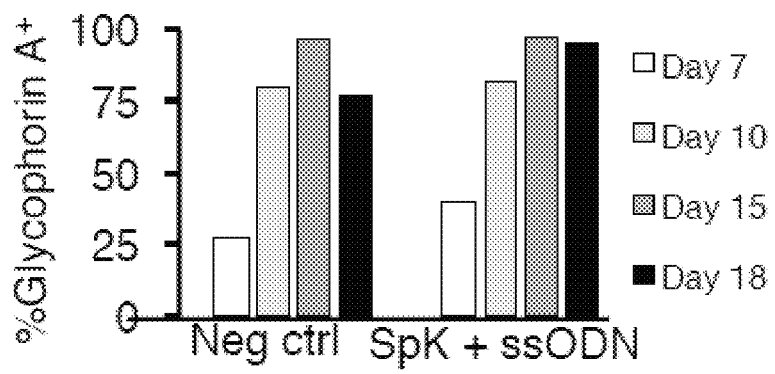

Gene editing and induction of fetal hemoglobin was also evaluated in human adult mPB CD34+ cells. Co-delivery of BCL11Ae RNP and nonspecific ssODN supported ~20% indels at the target site (FIG. 15A). To evaluate early induction of fetal hemoglobin in erythroid progeny of edited cells, mPB CD34+ cells were differentiated into erythroblasts and induction of fetal hemoglobin transcription (HBG mRNA) was evaluated by qRT-PCR analysis. The erythroid progeny of BCL11Ae RNP treated CD34+ cells exhibited a 2-fold induction of HBG mRNA compared to untreated controls, suggesting induction of fetal hemoglobin expression (FIG. 15B). The RNP treated marrow CD34+ cells also maintained similar kinetics of differentiation (phenotype acquisition, FIG. 15C) compared to donor matched untreated control cells.

Example 8: Electroporation of Cas9 RNP Targeting the Distal CCAAT Box at the HBG Promoter in Human Hematopoietic Stem/Progenitor Cells Generates Several Deletions that Promote HBG Expression after Erythroid Differentiation Hereditary persistence of fetal hemoglobin (HPFH phenotype) is observed in patients carrying a 13 nt deletion overlapping with the HBG distal CCAAT box. Cas9-RNP targeting the HBG distal CCAAT box can be used in hematopoietic stem/progenitor cells (HSPCs) to reproduce the HPFH phenotype, likely by disrupting the binding sites of transcription factors repressing HBG expression. DNA double strand breaks (DSBs) created by Cas9 RNP can lead to a variety of repair outcomes, including insertions and deletions proximal to the RNP cut site. Some of the introduced indels may disrupt the binding of repressing factors less efficiently. It was envisioned that ssODN donor templates could be used to improve the frequency of indels reproducing the HPFH phenotype by directing the repair towards specific deletions that leads to HBG gene expression.

Figure 16:
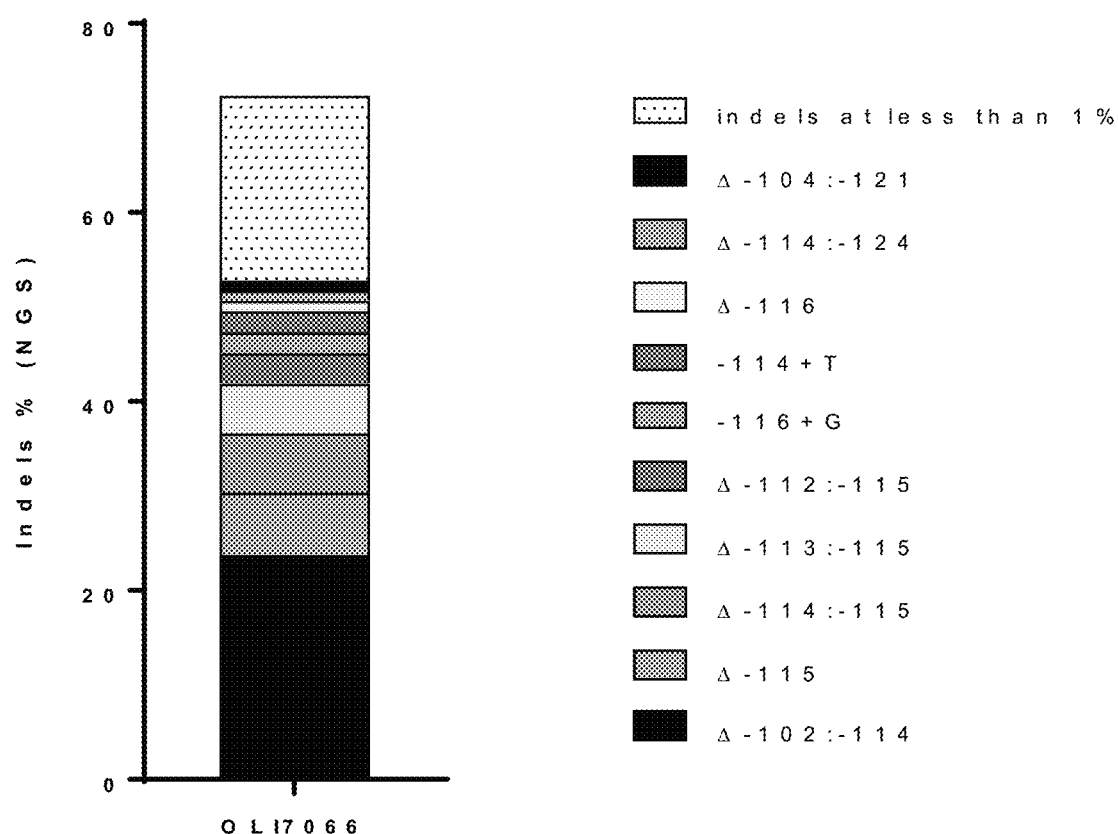
FIG. 16 depicts the percentage of indels detected by next generation sequencing (NGS) of the HBG PCR product amplified from gDNA extracted from hematopoietic stem/progenitor cells (HSPCs) treated with Cas9 complexed with the chemically synthesized guide RNA OLI7066 (SEQ ID NO:970, Table 10) ("OLI7066-RNP") at a concentration of 16 μM. Various indels were identified including HBG Δ-102:-121, HBG Δ-114:-124, HBG Δ-116, HBG-114+T, HBG-116+G, HBG Δ-112:-115, HBG Δ-113:-115, HBG Δ-114:-115, HBG Δ-115, HBG Δ-102:-114 (the naturally occurring 13 nt deletion).
Figure 17A:
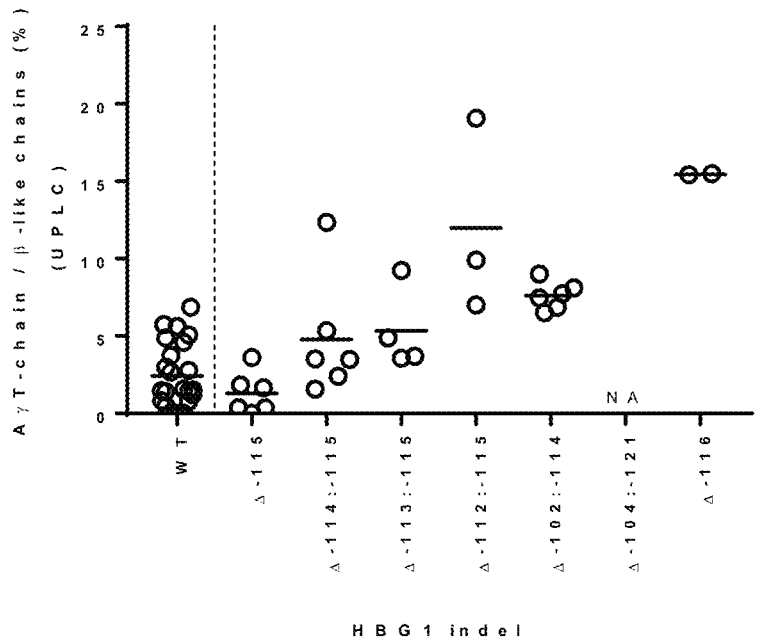
FIGS. 17A-D depict expression levels of G gamma (Gγ)-globin, A gamma (Aγ)-globin chain (or AG gamma (AGγ)-globin resulting from the 4.9 kb deletion) as determined by [gamma chain]/[all-gamma chains+beta chain] compared to relative indels carried at HBG1 or HBG2 as measured by UPLC analysis in the erythroid progeny of single HSPC that were electroporated with Cas9 complexed with the gRNA OLI7066 (SEQ ID NO:970) ("OLI7066-RNP") (Table 10).
Figure 17B:
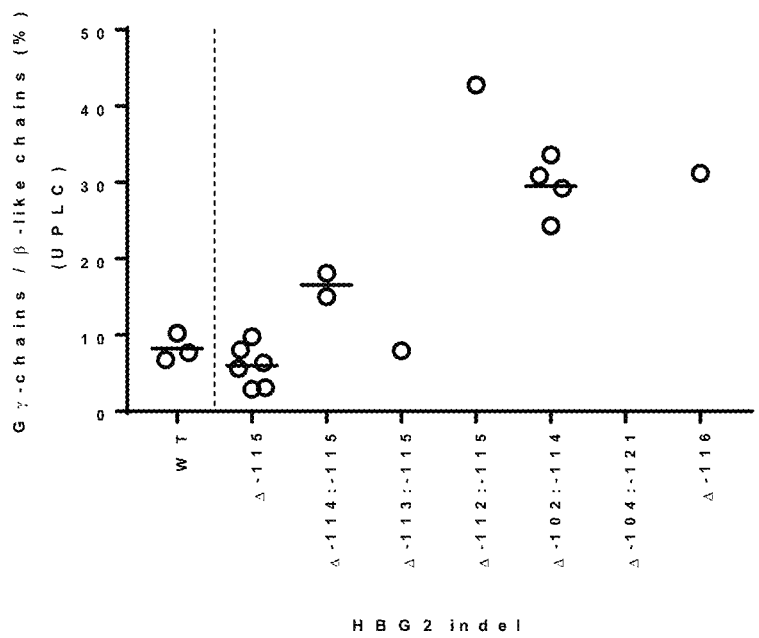
Figure 17C:
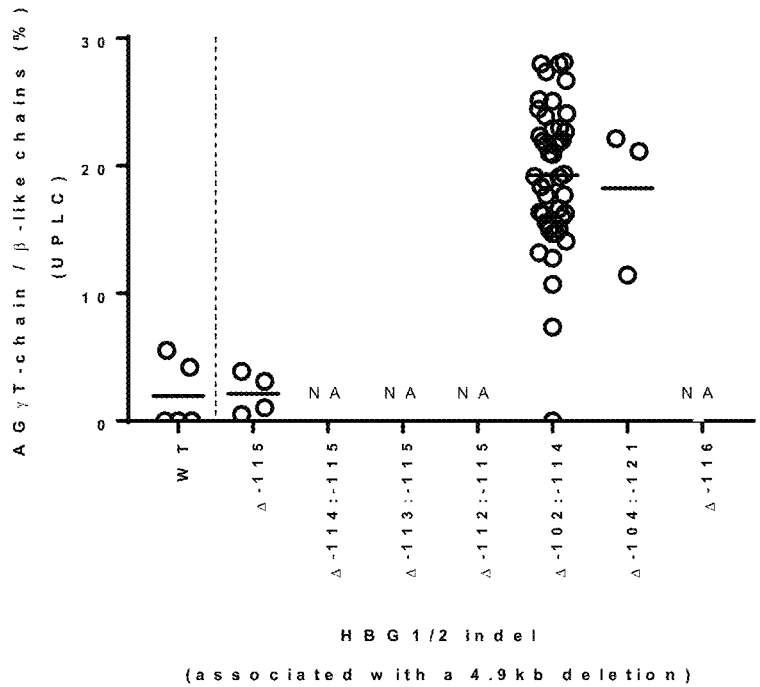
Figure 17D:
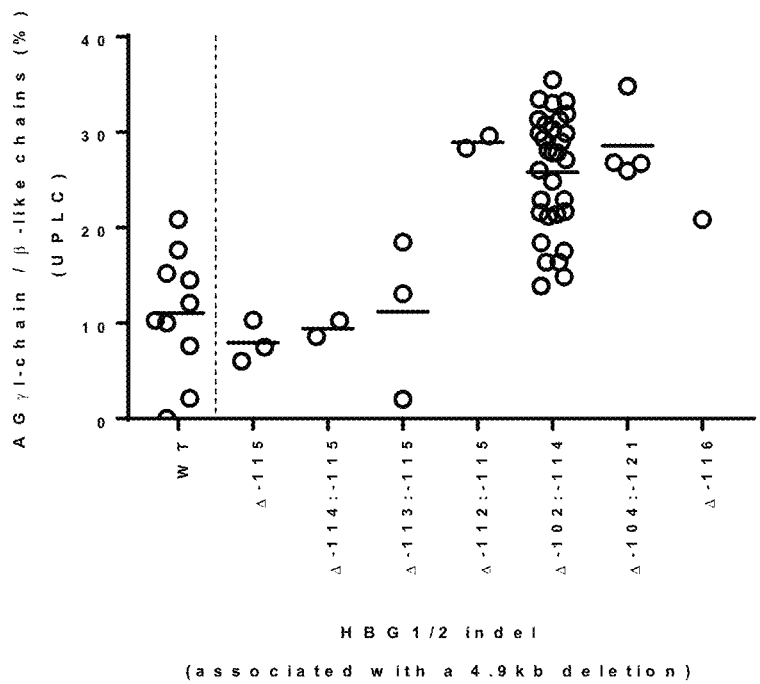

To evaluate the repair outcome of Cas9-RNP targeting the distal CCAAT box at the HBG promoter, Cas9 was complexed with the chemically synthesized guide RNA OLI7066 (SEQ ID NO:970, Table 10) ("OLI7066-RNP") and RNP were electroporated into HSPCs at 16 μM. Sequencing analysis (next generation sequencing) performed at day 2 post-electroporation indicated that 23.7% of the alleles carried the 13 nt deletion identical to the naturally occurring HPFH mutation (FIG. 16, 13 nt deletion indicated by "Δ-102:-114"). Several other frequent deletions were also observed around the OLI7066-RNP cut site (FIG. 16).

TABLE 10

Sequences of chemically synthesized gRNA targeting the CCAAT box, with or without end modifications.

| Name | Oli-ID | gRNA sequence (RNA) | gRNA sequence (DNA) |
| --- | --- | --- | --- |
| Sp35 unmodified | OLI7066 | CUUGUCAAGGCUAUUGGUCAG UUUUAGAGCUAGAAAUAGCAA GUUAAAAUAAGGCUAGUCCGU UAUCAACUUGAAAAAGUGGCA CCGAGUCGGUGCUUUU (SEQ ID NO: 970) | CTTGTCAAGGCTATTGGTCA GTTTTAGAGCTAGAAATAGC AAGTTAAAATAAGGCTAGTC CGTTATCAACTTGAAAAAGT GGCACCGAGTCGGTGCTTTT (SEQ ID NO: 972) |
| Sp35 5'-3' PSOMe | OLI8394 | mC*mU*mU*GUCAAGGCUAUUG GUCAGUUUUAGAGCUAGAAAU AGCAAGUUAAAAUAAGGCUAG UCCGUUAUCAACUUGAAAAAG UGGCACCGAGUCGGUGCmU*m U*mU*U (SEQ ID NO: 971) | mC*mT*mT*GTCAAGGCTATT GGTCAGTTTTAGAGCTAGAA ATAGCAAGTTAAAATAAGGC TAGTCCGTTATCAACTTGAA AAAGTGGCACCGAGTCGGTG CmT*mT*mT*T (SEQ ID NO: 973) |

*Represents phosphorothioate modification
m: Represents 2-o-methyl modification

A single cell experiment was performed to evaluate the level of HbF expression induced by the most frequent deletions generated by delivery of RNP (Cas9 complexed with the gRNA OLI7066 (SEQ ID NO:970) ("OLI7066-RNP")) targeting the distal CCAAT box. Briefly, single HSPC electroporated with OLI7066-RNP complexes targeting the distal CCAAT box were plated in single wells and differentiated into erythroid cells by culturing for 18 days in the presence of human cytokines (erythropoietin, SCF, IL3), human plasma (Octoplas), and other supplements (hydrocortisone, heparin, transferrin, insulin). A fraction of the erythroid progeny from each single cell was split after 14 days for gDNA extraction. Sequencing analysis of the PCR product from HBG1 and HBG2 was performed to identify the genotype of each clonal population. ddPCR analysis was also performed on the genomic DNA of each clonal populations to detect deletions of the 4.9 kb fragment between the guide RNA target sites in HBG1 and HBG2. At day 18, the erythroid cells deriving from each clone were lysed and the relative expression of the globin chains was determined by ultra-performance liquid chromatography (UPLC). Finally, the level of G-gamma (Gγ)-globin, A-gamma (Aγ)-globin chain expression (or AG-gamma (AGγ)-globin resulting from the 4.9 kb deletion) as determined by [gamma chain]/ [all-gamma chains+beta chain] was compared relative to the indels carried at HBG1 and HBG2 respectively. The 13 nt deletion that reproduces the HPFH genotype was shown to induce HBG expression. In addition several unique non-naturally occurring deletions that induced HBG expression at comparable levels were identified. These include HBG Δ-112:-115 ("4 nt deletion"), HBG Δ-104:-121 ("18 nt deletion"), HBG Δ-116 ("1 nt deletion") (FIGS. 17A-D).

Figure 18:
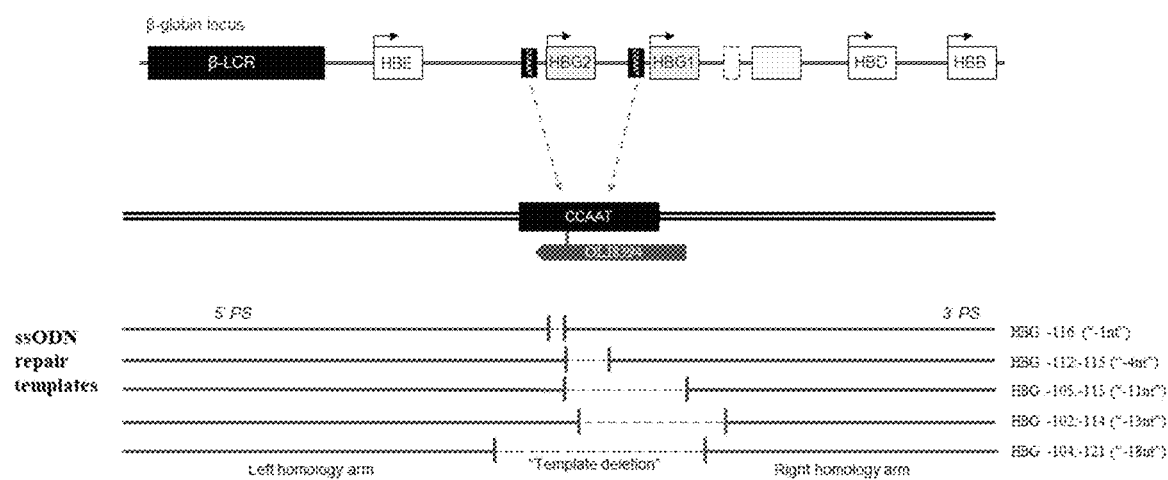
FIG. 18 depicts, in schematic form, HBG1 and HBG2 gene(s) in the context of the β-globin gene cluster on human chromosome 11. The schematic shows the CCAAT box target sites at HBG1 and HBG2. Due to the homology within this region, a single guide RNA, such as OLI8394 (SEQ ID NO:971), complexed to an RNA nuclease (e.g., Cas9) will cut at both HBG1 and HBG2. The editing outcomes following delivery of Cas9 complexed to OLI8394 ("OLI8394-RNP") vary and result in different size deletions or insertions. Single stranded oligodeoxynucleotides (ssODN) were designed to provide a template that copies the desired indel signature at the CCAAT box (Table 11). The ssODN "encodes" the respective deletion with sequence homology arms flanking the absent sequence to create a perfect deletion.

Example 9: Co-Delivery of Cas9 RNP Targeting the Region at or Near the Distal CCAAT Box with ssODN Donors Supports Precise Gene Editing in Human Hematopoietic Stem/Progenitor Cells and Increased Gamma-Globin Expression in the Erythroid Progeny To improve the frequency of HbF inducing indels in HSPC, single strand deoxynucleotide donor repair templates (ssODNs) "encoding" identified HbF inducing deletions (e.g., the "Int" (HBG Δ-116) and "4nt" (HBG Δ-112:-115) deletions) were designed (FIG. 18). ssODNs used to induce these deletions were as follows: "nt" ssODNs: OLI16417-18; "4nt" ssODNs: OLI6424, OLI6430, Table 11). ssODNs were designed with 90 nt homology arms flanking this absent sequence to create a perfect deletion. The ssODNs were modified to contain phosphorothioates (PhTx) at the 5' and 3' ends. Additional ssODNs were designed to encode naturally occurring mutations observed in patients with HPFH (e.g., HBG Δ-102:-114 ("13 nt" deletion, FIG. 18) and HBG-117 G>A mutation ("HBG-117 G>A"). ssODNs used to induce these deletions were as follows: "13nt" ssODN: OLI16412, OLI16414 and "−117 G>A" ssODN: OLI16415-16, Table 11). Finally, to facilitate the evaluation of gene correction, ssODNs (OLI16411, OLI16413, Table 11) were designed to encode an 11 nt deletion overlapping the distal CCAAT box that occurs at low frequency after electroporation of OLI8394-RNP alone (0.100, see FIG. 191B, FIG. 18).

TABLE 11

Single strand deoxynucleotide donor repair templates "encoding" deletions or mutations at or near the CCAAT box

| ssODN ID | OLI-ID | Sequence |
| --- | --- | --- |
| Ptx ssODN - Positive Strand -18nt (180) | OLI16409 | G*GTGCTTCCTTTTATTCTTCATCCCTAGCCAGCCGCCGGCCCC TGGCCTCACTGGATACTCTAAGACTATTGGTCAAGTTTGCCTT GTCAAGGCTGGCCAACCCATGGGTGGAGTTTAGCCAGGGACC GTTTCAGACAGATATTTGCATTGAGATAGTGTGGGGAAGGGG CCCCCAAGA*G (SEQ ID NO: 974) |
| Ptx ssODN - Negative Strand -18nt (180) | OLI16410 | C*TCTTGGGGGCCCCTTCCCCACACTATCTCAATGCAAATATC TGTCTGAAACGGTCCCTGGCTAAACTCCACCCATGGGTTGGCC AGCCTTGACAAGGCAAACTTGACCAATAGTCTTAGAGTATCC AGTGAGGCCAGGGGCCGGCGGCTGGCTAGGGATGAAGAATA AAAGGAAGCAC*C (SEQ ID NO: 975) |
| Ptx ssODN - Negative Strand -11nt (180) | OLI16411 | G*GCCCCTTCCCCACACTATCTCAATGCAAATATCTGTCTGAA ACGGTCCCTGGCTAAACTCCACCCATGGGTTGGCCAGCCTTGC CTTGAGACAAGGCAAACTTGACCAATAGTCTTAGAGTATCCA GTGAGGCCAGGGGCCGGCGGCTGGCTAGGGATGAAGAATAA AAGGAAGCACC*C (SEQ ID NO: 976) |
| Ptx ssODN - Negative Strand -13nt (180) | OLI16412 | G*GCCCCTTCCCCACACTATCTCAATGCAAATATCTGTCTGAA ACGGTCCCTGGCTAAACTCCACCCATGGGTTGGCCAGCCTTGC CTTGACAAGGCAAACTTGACCAATAGTCTTAGAGTATCCAGT GAGGCCAGGGGCCGGCGGCTGGCTAGGGATGAAGAATAAAA GGAAGCACCCT*T (SEQ ID NO: 977) |
| Ptx ssODN - Positive Strand -11nt (180) | OLI16413 | G*GGTGCTTCCTTTTATTCTTCATCCCTAGCCAGCCGCCGGCCC CTGGCCTCACTGGATACTCTAAGACTATTGGTCAAGTTTGCCT TGTCTCAAGGCAAGGCTGGCCAACCCATGGGTGGAGTTTAGC CAGGGACCGTTTCAGACAGATATTTGCATTGAGATAGTGTGG GGAAGGGGC*C (SEQ ID NO: 978) |
| Ptx ssODN - Positive Strand -13nt (180) | OLI16414 | A*AGGGTGCTTCCTTTTATTCTTCATCCCTAGCCAGCCGCCGGC CCCTGGCCTCACTGGATACTCTAAGACTATTGGTCAAGTTTGC CTTGTCAAGGCAAGGCTGGCCAACCCATGGGTGGAGTTTAGC CAGGGACCGTTTCAGACAGATATTTGCATTGAGATAGTGTGG GGAAGGGGC*C (SEQ ID NO: 979) |
| Ptx ssODN - Negative Strand 117: G>A (180) | OLI16415 | G*GCCCCTTCCCCACACTATCTCAATGCAAATATCTGTCTGAA ACGGTCCCTGGCTAAACTCCACCCATGGGTTGGCCAGCCTTGC CTTAACCAATAGCCTTGACAAGGCAAACTTGACCAATAGTCTT AGAGTATCCAGTGAGGCCAGGGGCCGGCGGCTGGCTAGGGAT GAAGAATAA*A (SEQ ID NO: 980) |
| Ptx ssODN - Positive Strand 117: G>A (180) | OLI16416 | T*TTATTCTTCATCCCTAGCCAGCCGCCGGCCCCTGGCCTCACT GGATACTCTAAGACTATTGGTCAAGTTTGCCTTGTCAAGGCTA TTGGTTAAGGCAAGGCTGGCCAACCCATGGGTGGAGTTTAGC CAGGGACCGTTTCAGACAGATATTTGCATTGAGATAGTGTGG GGAAGGGGC*C (SEQ ID NO: 981) |

TABLE 11-continued

Single strand deoxynucleotide donor repair templates "encoding" deletions or mutations at or near the CCAAT box

| ssODN ID | OLI-ID | Sequence |
|---|---|---|
| Ptx ssODN - Negative Strand -1nt (180) | OLI16417 | G*GCCCCTTCCCCACACTATCTCAATGCAAATATCTGTCTGAA ACGGTCCCTGGCTAAACTCCACCCATGGGTTGGCCAGCCTTGC CTTGCCAATAGCCTTGACAAGGCAAACTTGACCAATAGTCTTA GAGTATCCAGTGAGGCCAGGGGCCGGCGGCTGGCTAGGGATG AAGAATAAA*A (SEQ ID NO: 982) |
| Ptx ssODN - Positive Strand -1nt (180) | OLI16418 | T*TTTATTCTTCATCCCTAGCCAGCCGCCGGCCCCTGGCCTCAC TGGATACTCTAAGACTATTGGTCAAGTTTGCCTTGTCAAGGCT ATTGGCAAGGCAAGGCTGGCCAACCCATGGGTGGAGTTTAGC CAGGGACCGTTTCAGACAGATATTTGCATTGAGATAGTGTGG GGAAGGGGC*C (SEQ ID NO: 983) |
| Ptx ssODN - Negative Strand -4nt 40/80 (120) | OLI16419 | T*GGCTAAACTCCACCCATGGGTTGGCCAGCCTTGCCTTGATA GCCTTGACAAGGCAAACTTGACCAATAGTCTTAGAGTATCCA GTGAGGCCAGGGGCCGGCGGCTGGCTAGGGATGAA*G (SEQ ID NO: 984) |
| Ptx ssODN - Negative Strand -4nt 30/70 (100) | OLI16420 | C*CACCCATGGGTTGGCCAGCCTTGCCTTGATAGCCTTGACAA GGCAAACTTGACCAATAGTCTTAGAGTATCCAGTGAGGCCAG GGGCCGGCGGCTGGC*T (SEQ ID NO: 985) |
| Ptx ssODN - Negative Strand -4nt (100) | OLI16421 | A*AACGGTCCCTGGCTAAACTCCACCCATGGGTTGGCCAGCCT TGCCTTGATAGCCTTGACAAGGCAAACTTGACCAATAGTCTTA GAGTATCCAGTGAG*G (SEQ ID NO: 986) |
| Ptx ssODN - Negative Strand -4nt (120) | OLI16422 | T*ATCTGTCTGAAACGGTCCCTGGCTAAACTCCACCCATGGGT TGGCCAGCCTTGCCTTGATAGCCTTGACAAGGCAAACTTGACC AATAGTCTTAGAGTATCCAGTGAGGCCAGGGGCC*G (SEQ ID NO: 987) |
| Ptx SSODN - Negative Strand -4nt (140) | OLI16423 | T*CAATGCAAATATCTGTCTGAAACGGTCCCTGGCTAAACTCC ACCCATGGGTTGGCCAGCCTTGCCTTGATAGCCTTGACAAGGC AAACTTGACCAATAGTCTTAGAGTATCCAGTGAGGCCAGGGG CCGGCGGCTGGC*T (SEQ ID NO: 988) |
| Ptx ssODN - Negative Strand -4nt (180) | OLI16424 | G*GCCCCTTCCCCACACTATCTCAATGCAAATATCTGTCTGAA ACGGTCCCTGGCTAAACTCCACCCATGGGTTGGCCAGCCTTGC CTTGATAGCCTTGACAAGGCAAACTTGACCAATAGTCTTAGA GTATCCAGTGAGGCCAGGGGCCGGCGGCTGGCTAGGGATGAA GAATAAAGG* A (SEQ ID NO: 989) |
| Ptx ssODN - Positive Strand -4nt 40/80 (120) | OLI16425 | T*ACTCTAAGACTATTGGTCAAGTTTGCCTTGTCAAGGCTATC AAGGCAAGGCTGGCCAACCCATGGGTGGAGTTTAGCCAGGGA CCGTTTCAGACAGATATTTGCATTGAGATAGTGTG*G (SEQ ID NO: 990) |
| Ptx ssODN - Positive Strand -4nt 30/70 (100) | OLI16426 | C*TATTGGTCAAGTTTGCCTTGTCAAGGCTATCAAGGCAAGGC TGGCCAACCCATGGGTGGAGTTTAGCCAGGGACCGTTTCAGA CAGATATTTGCATTG*A (SEQ ID NO: 991) |
| Ptx ssODN - Positive Strand -4nt (100) | OLI16427 | C*CTCACTGGATACTCTAAGACTATTGGTCAAGTTTGCCTTGTC AAGGCTATCAAGGCAAGGCTGGCCAACCCATGGGTGGAGTTT AGCCAGGGACCGTT*T (SEQ ID NO: 992) |
| Ptx ssODN - Positive Strand -4nt (120) | OLI16428 | C*GGCCCCTGGCCTCACTGGATACTCTAAGACTATTGGTCAAG TTTGCCTTGTCAAGGCTATCAAGGCAAGGCTGGCCAACCCATG GGTGGAGTTTAGCCAGGGACCGTTTCAGACAGAT*A (SEQ ID NO: 993) |
| Ptx ssODN - Positive Strand -4nt (140) | OLI16429 | A*GCCAGCCGCCGGCCCCTGGCCTCACTGGATACTCTAAGACT ATTGGTCAAGTTTGCCTTGTCAAGGCTATCAAGGCAAGGCTGG CCAACCCATGGGTGGAGTTTAGCCAGGGACCGTTTCAGACAG ATATTTGCATTG*A (SEQ ID NO: 994) |
| Ptx ssODN - Positive Strand -4nt (180) | OLI16430 | T*CCTTTTATTCTTCATCCCTAGCCAGCCGCCGGCCCCTGGCCT CACTGGATACTCTAAGACTATTGGTCAAGTTTGCCTTGTCAAG GCTATCAAGGCAAGGCTGGCCAACCCATGGGTGGAGTTTAGC CAGGGACCGTTTCAGACAGATATTTGCATTGAGATAGTGTGG GGAAGGGGC*C (SEQ ID NO: 995) |

TABLE 11-continued

Single strand deoxynucleotide donor repair templates "encoding" deletions or mutations at or near the CCAAT box

| ssODN ID | OLI-ID | Sequence |
|---|---|---|
| Ptx ssODN - Positive Strand -18nt (100) | OLI16431 | C*CCTGGCCTCACTGGATACTCTAAGACTATTGGTCAAGTTTG CCTTGTCAAGGCTGGCCAACCCATGGGTGGAGTTTAGCCAGG GACCGTTTCAGACAG*A (SEQ ID NO: 1040) |

*Represents phosphorothioate modification

Figure 19A:
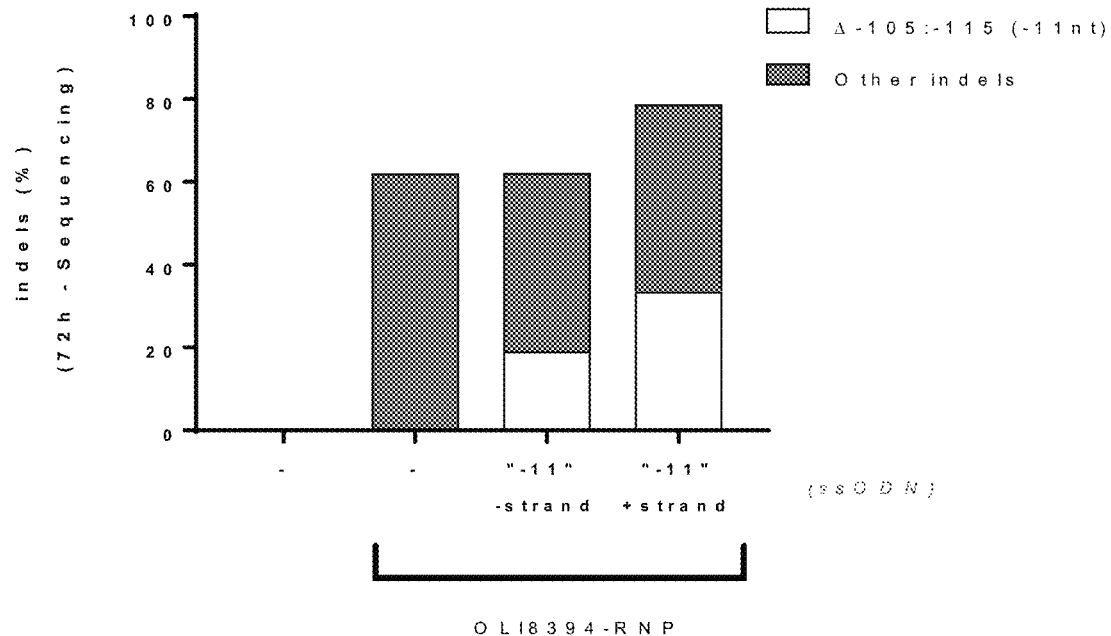
FIGS. 19A-G depict results from gene editing of the CCAAT box target region of HBG of adult human CD34+ cells from mPB ("mPB CD34+ cells") electroporated with 2 μM OLI8394-RNP or OLI7066-RNP and 2.5 μM of various ssODNs (Table 11).
Figure 19B:
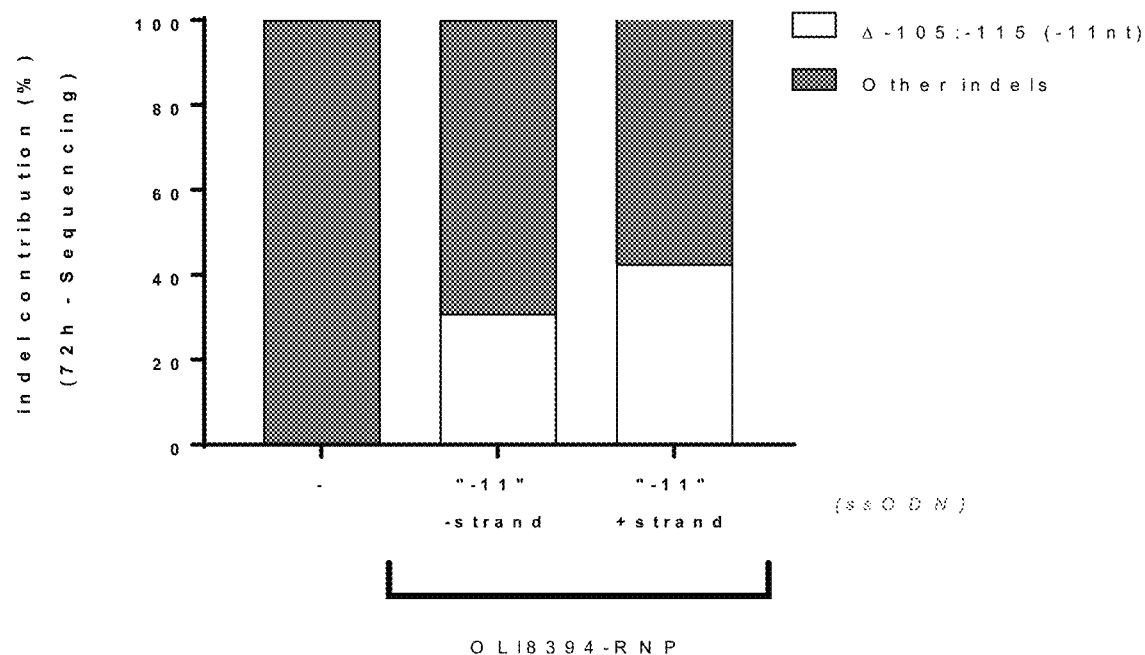
Figure 19C:
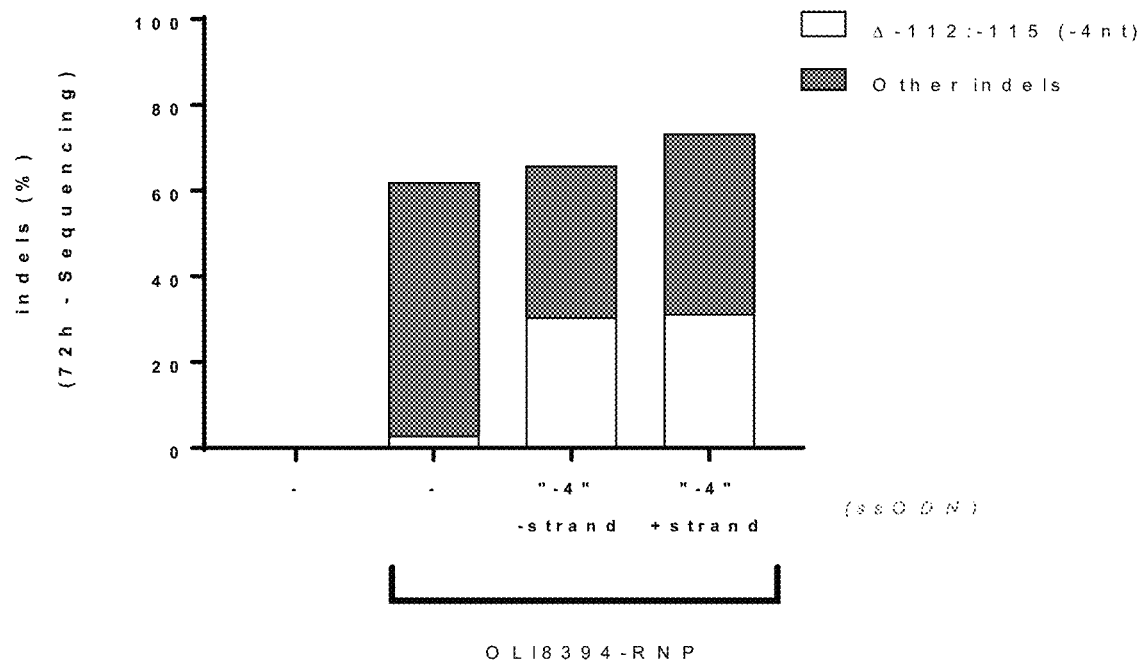
Figure 19D:
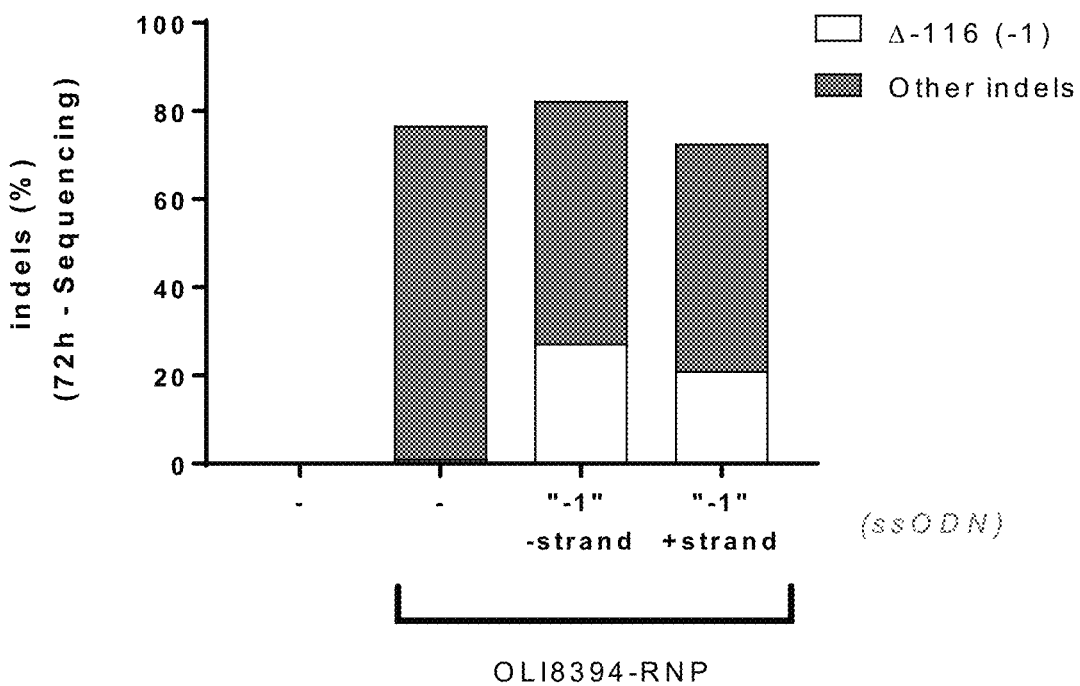
Figure 19E:
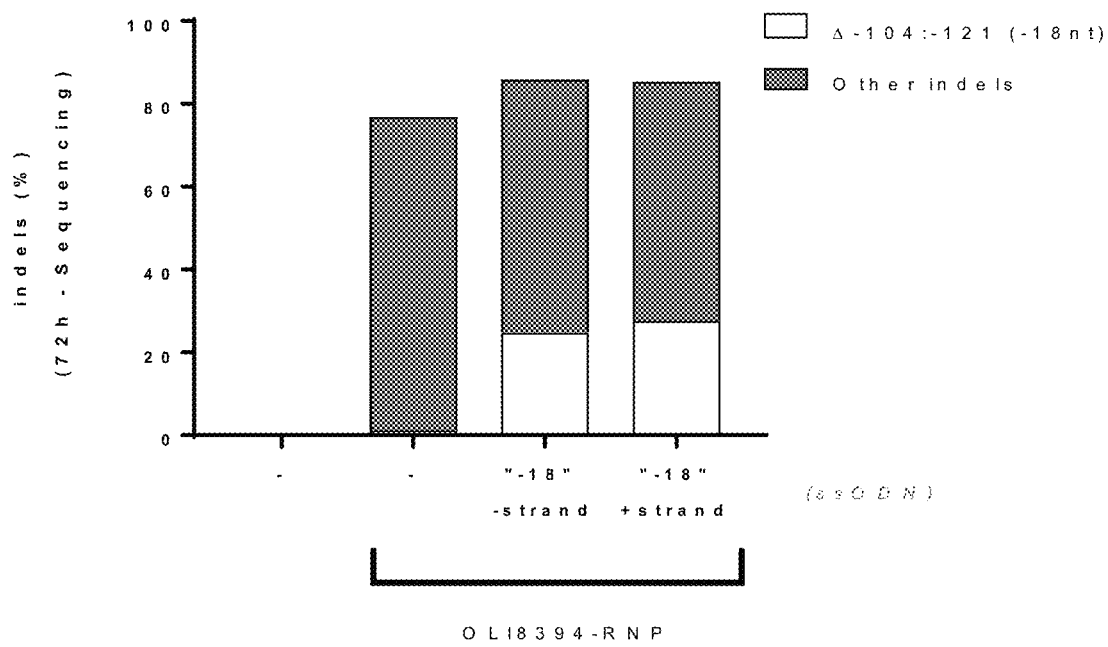
Figure 19F:
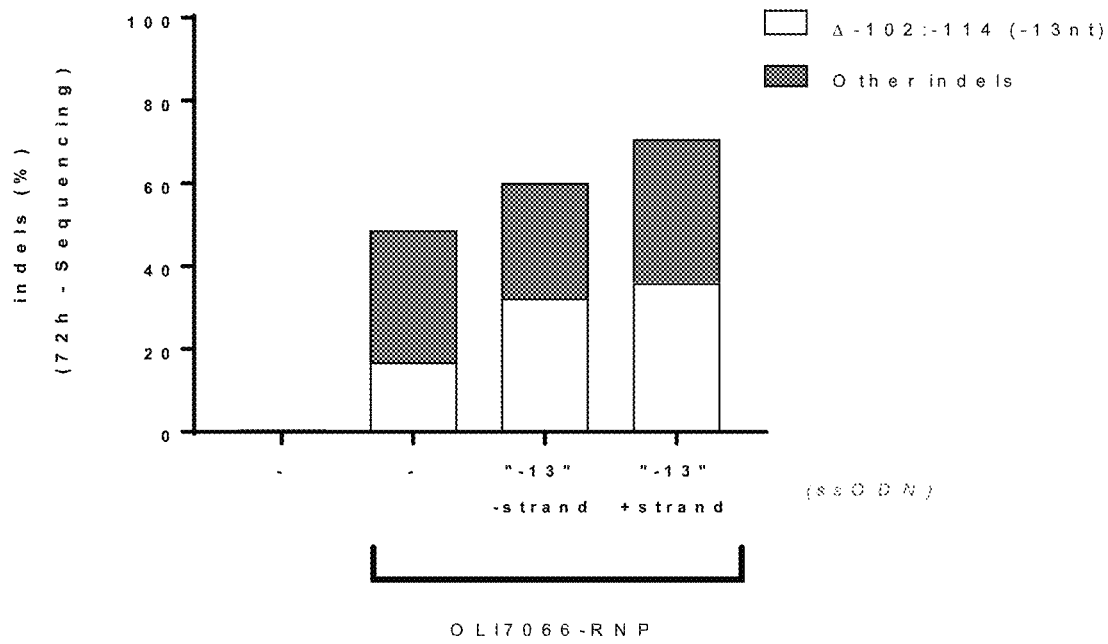
Figure 19G:
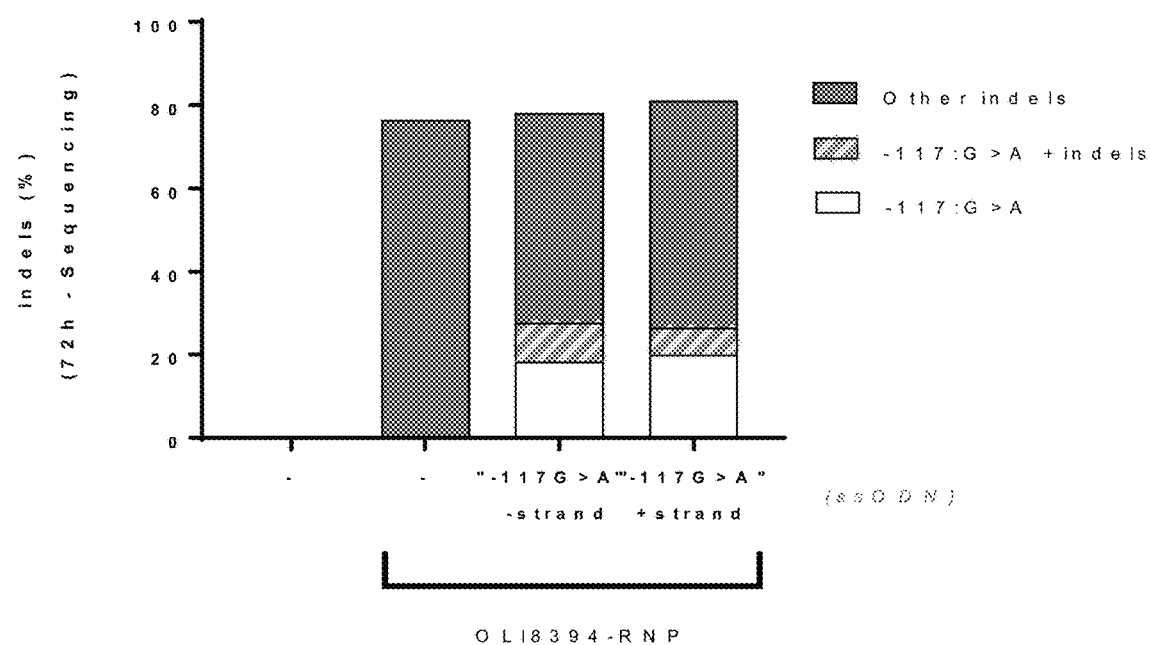

The ssODN donors, OLI16409-OLI16418, OLI16424 and OLI16430 (Table 11), were co-delivered to adult mPB CD34+ cells with Cas9 protein precomplexed to OLI8394 ("OLI8394-RNP") or Cas9 protein precomplexed to OLI7066 ("OLI7066-RNP") targeting the HBG distal CCAAT box (Table 10). Briefly, mLPB CD34+ cells were pre-stimulated for 2 days with human cytokines in X-Vivo-10 and then electroporated with a mixture composed of an ssODN donor at 2.5 µM and OLI8394-RNP or OLI7066-RNP at 2 µM. After three days post electroporation the genomic DNA was extracted, and next-generation sequencing was performed on the HBG PCR products. The level of editing was increased from 62.1% when using OLI8394-RNP alone to up to 78.73% when co-delivering "-11" ssODN (i.e., OLI16411 or OLI16413) (FIG. 19A). The level of gene correction mediated by the co-delivery of the ssODN templates to human HSPC was shown to contribute to up to 42.4% of total indels as measured by the frequency of the "-11" deletion within total indels detected by sequencing of the HBG PCR product from HSPC electroporated with OLI8394-RNP+"11" ssODN (FIG. 19B). Efficient gene correction was observed across other ssODN templates and OLI8394-RNP (FIGS. 19C-E, G) or OLI7066-RNP (FIG. 19F).

Figure 20A:
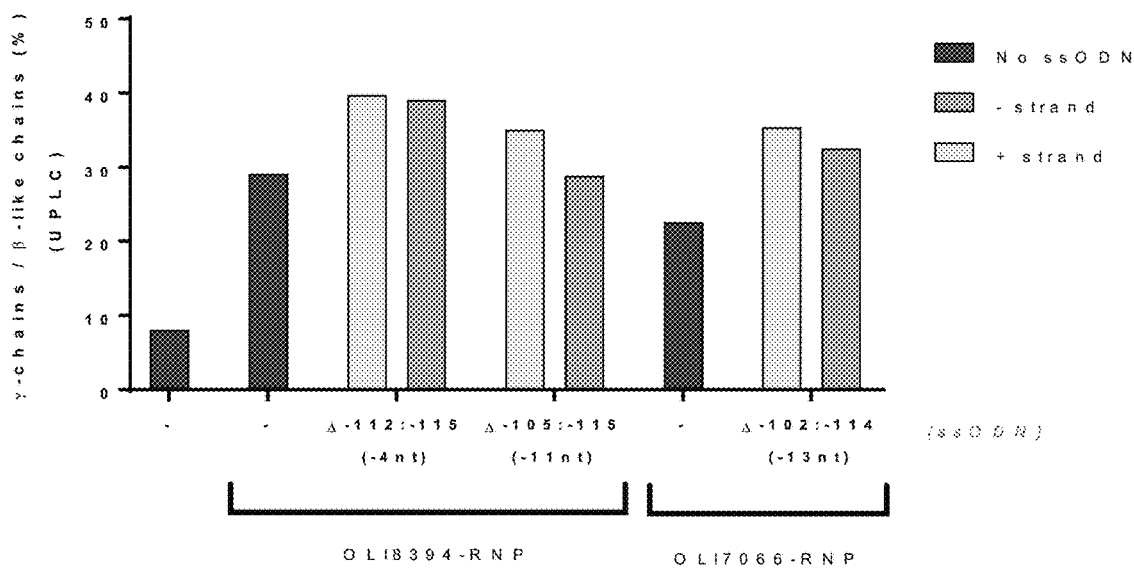
FIGS. 20A-B depict expression levels of gamma-globin chains over total beta-like globin chains (gamma chains/[gamma chains+beta chain]) as measured by UPLC analysis on the erythroid progeny of mPB CD34+ cells that were electroporated with OLI8394-RNP or OLI7066-RNP and various ssODNs (Table 11).
Figure 20B:
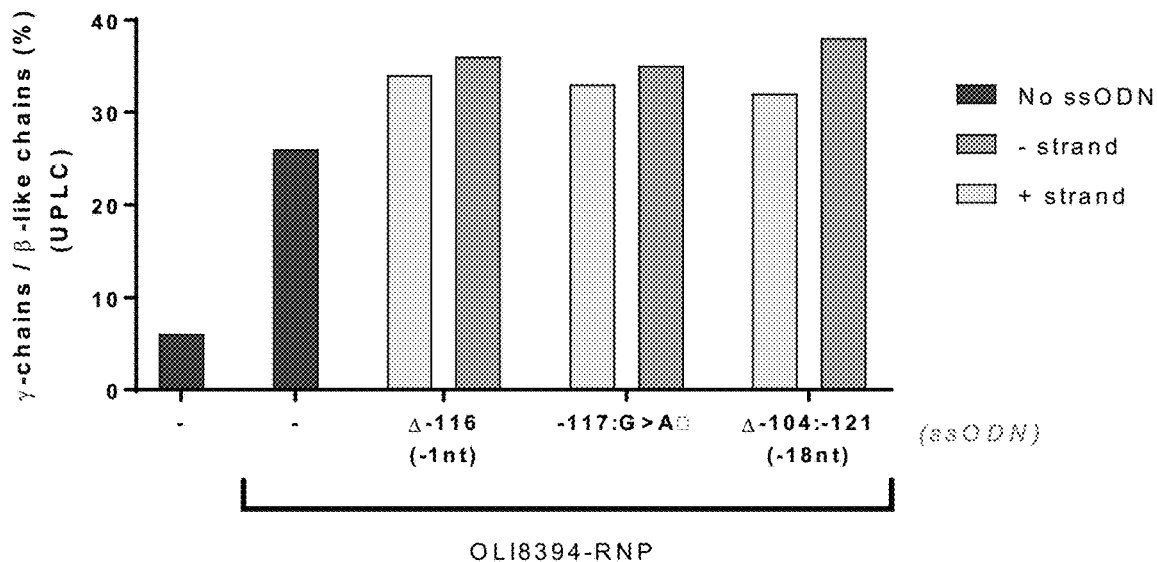

The mPB CD34+ cells electroporated with OLI8394-RNP or OLI7066-RNP co-delivered with ssODN templates were differentiated into erythroid cells to evaluate the level of gamma-globin expression resulting from the gene editing. To determine whether co-delivering RNP with ssODNs increased the production of fetal hemoglobin in the erythroid progeny of edited adult CD34+ cells, the cells were differentiated into erythroid cells by culture for 18 days in the presence of human cytokines (erythropoietin, SCF, IL3), human plasma (Octoplas), and other supplements (hydrocortisone, heparin, transferrin, insulin). At day 18, the relative expression levels of gamma-globin chains over total beta-like globin chains (gamma chains/[gamma chains+beta chain]) was measured by UPLC. Up to 39.1% of gamma-globin was detected after co-delivery of ssODN instead of 29% when using OLI8394-RNP alone (FIGS. 20A-B).

Figure 21A:
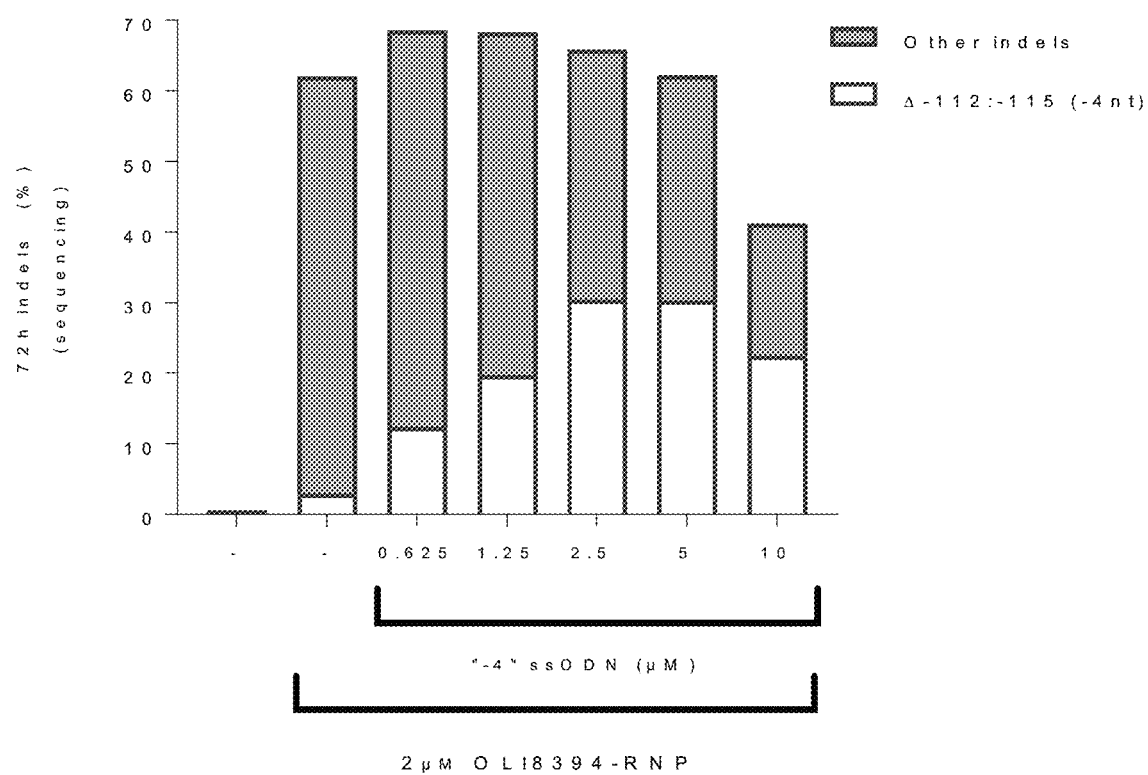
FIGS. 21A-D depict results from gene editing from mPB CD34+ cells electroporated with 2 μM OLI8394-RNP and ssODN OLI16424 ("−4 nt− strand") (Table 11) at doses ranging from 0.625 μM to 10 μM.
Figure 21B:
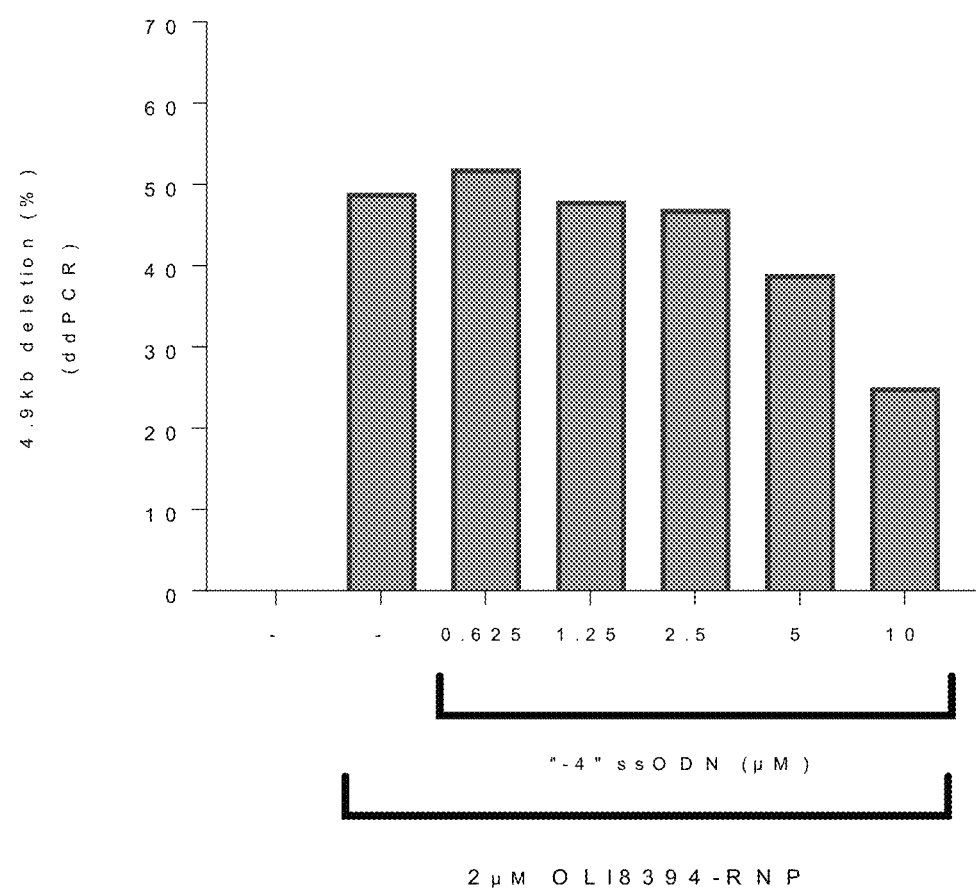
Figure 21C:
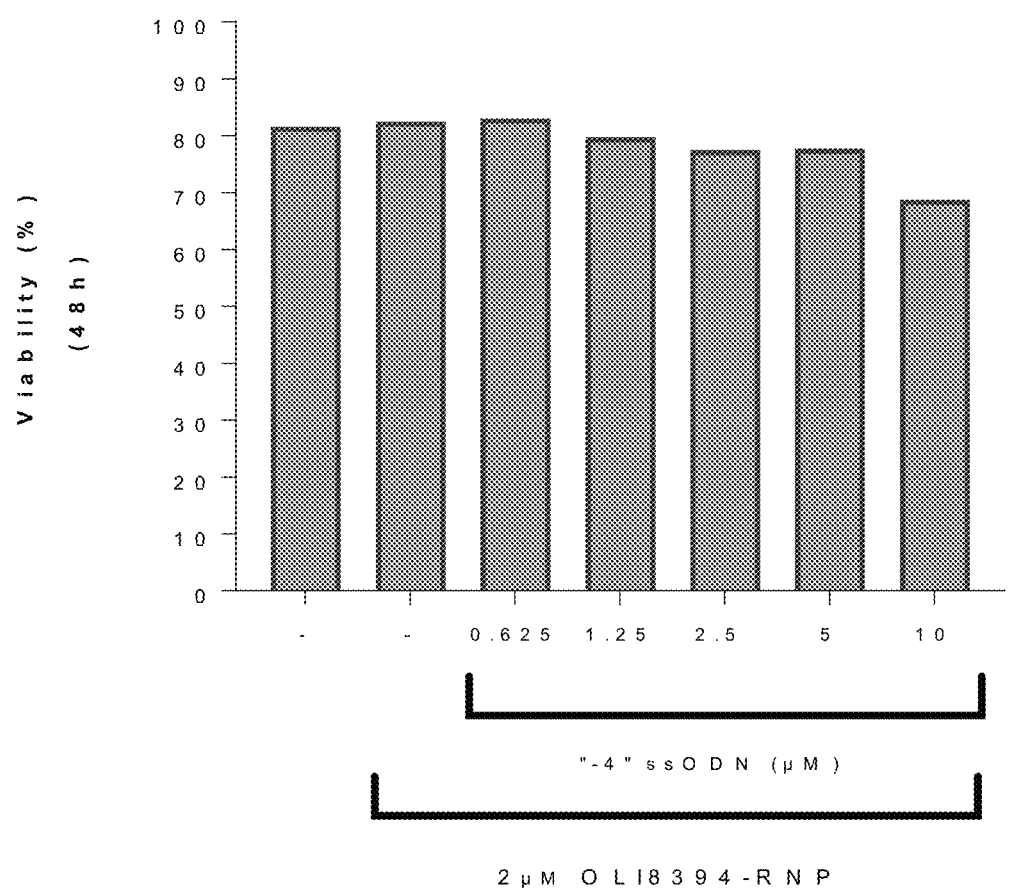
Figure 21D:
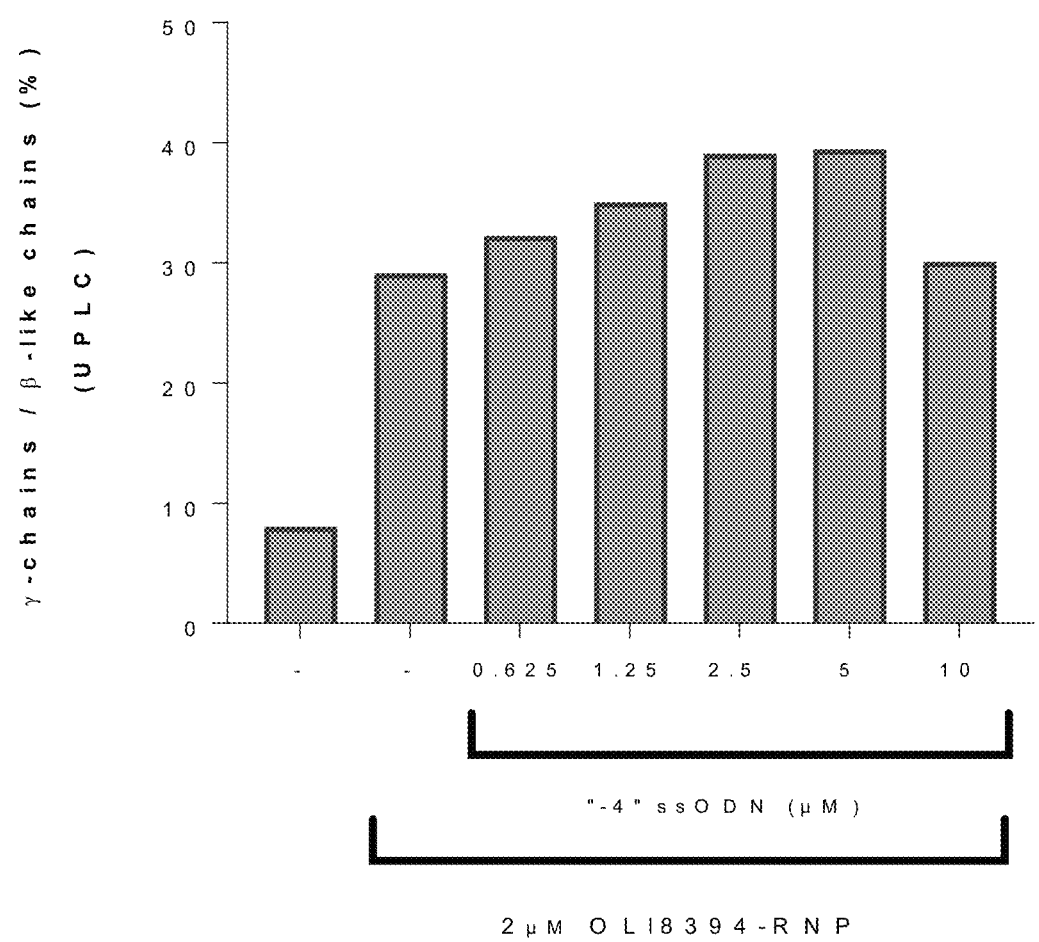

The effect of the dose of ssODN was evaluated using ssODN OLI16424. mPB CD34+ cells were pre-stimulated for 2 days with human cytokines in X-Vivo-10 and then electroporated with a mixture composed of OLI16424-ssODN at doses ranging from 0.625 µM to 10 µM and OLI8394-RNP at 2 µM. After three days post electroporation the genomic DNA was extracted, and next-generation sequencing was performed on the HBG PCR products. Increasing the dose of ssODN up to 5 µM resulted in increased gene correction and reduced frequency of 4.9 kb deletions between HBG1 and HBG2 (as measured by ddPCR), while maintaining overall editing level and without affecting cell viability (FIGS. 21A-C). The level of gamma-globin increased up to 39.5% of total beta-like chains at the 5 µM dose of ssODN (FIG. 21D), as measured by UPLC analysis of the cell lysates after 18 days of erythroid culture.

Figures 22A, 22B:
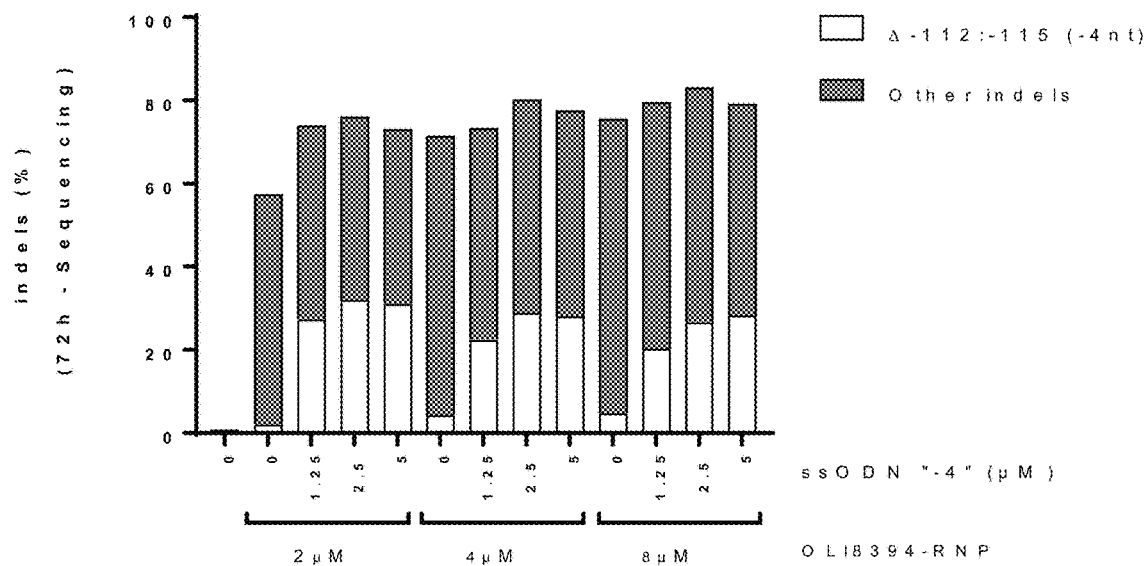
FIGS. 22A-D depict results from gene editing from mPB CD34+ cells electroporated with indicated doses of OLI8394-RNP and indicated doses of ssODN OLI16424 ("−4 nt− strand") (Table 11).
Figure 22C:
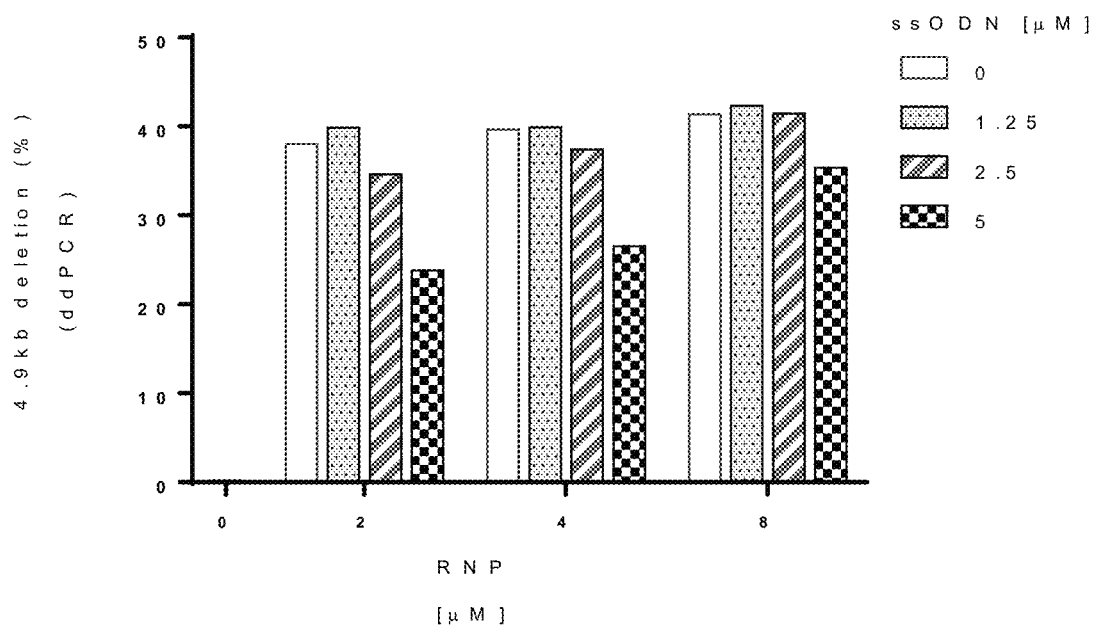
Figure 22D:
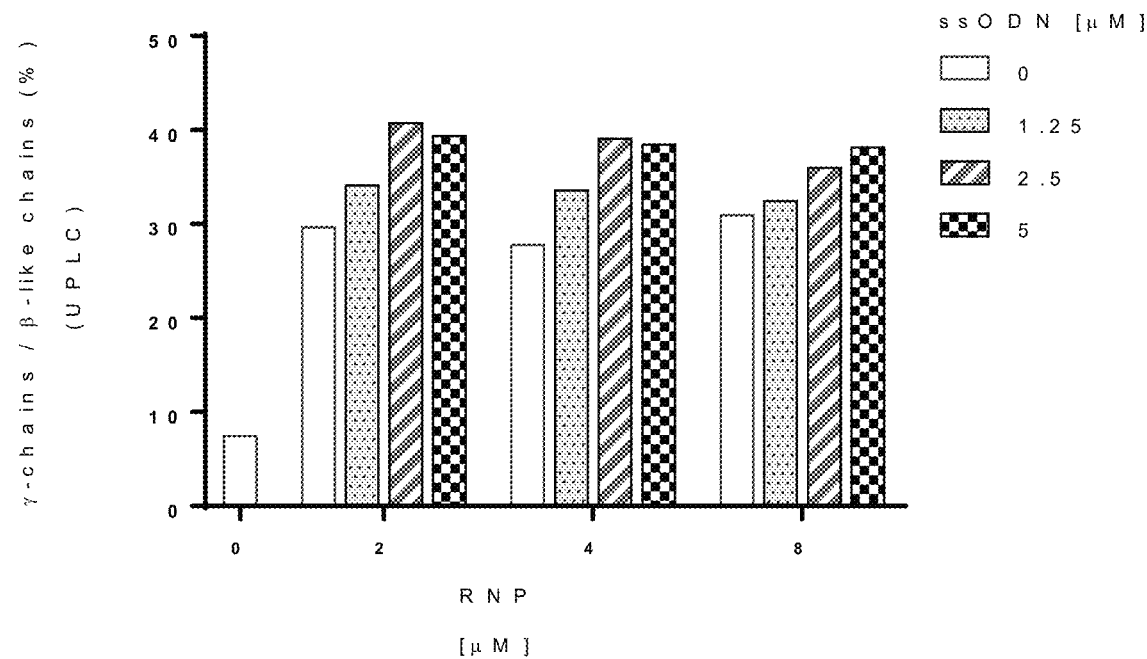

The co-delivery of the OLI8394-RNP and the OLI16424 ssODN was further optimized by varying the relative dose of ssODN and RNP. mPB CD34+ cells were pre-stimulated for 2 days with human cytokines in X-Vivo-10 and then electroporated with a mixture composed of OLI16424-ssODN at doses ranging from 1.25 µM to 5 µM and OLI8394-RNP at 2 µM to 8 µM. After three days post electroporation the genomic DNA was extracted, and next-generation sequencing was performed on the HBG PCR products. An improved gene editing outcome, i.e., a lower frequency of 4.9 kb deletions between the HBG1 and HBG2 genes and a higher level of gene correction, was achieved with a lower RNP dose combined with a higher ssODN dose (FIG. 22A-C). This resulted in the highest level of gamma-globin expression after erythroid differentiation (FIG. 22D).

Figure 23A:
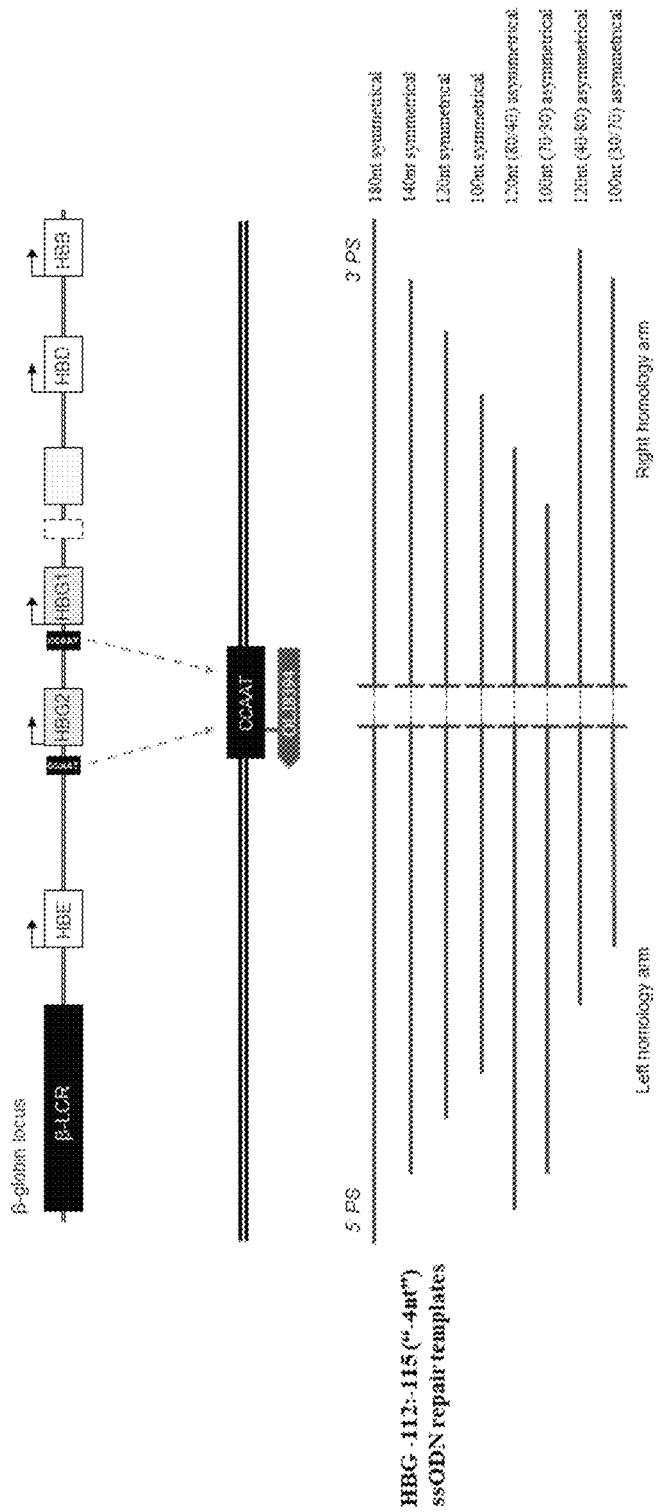
FIGS. 23A-B depict a schematic of and results provided by ssODN templates with symmetrical and asymmetrical homology arms.
Figure 23B:
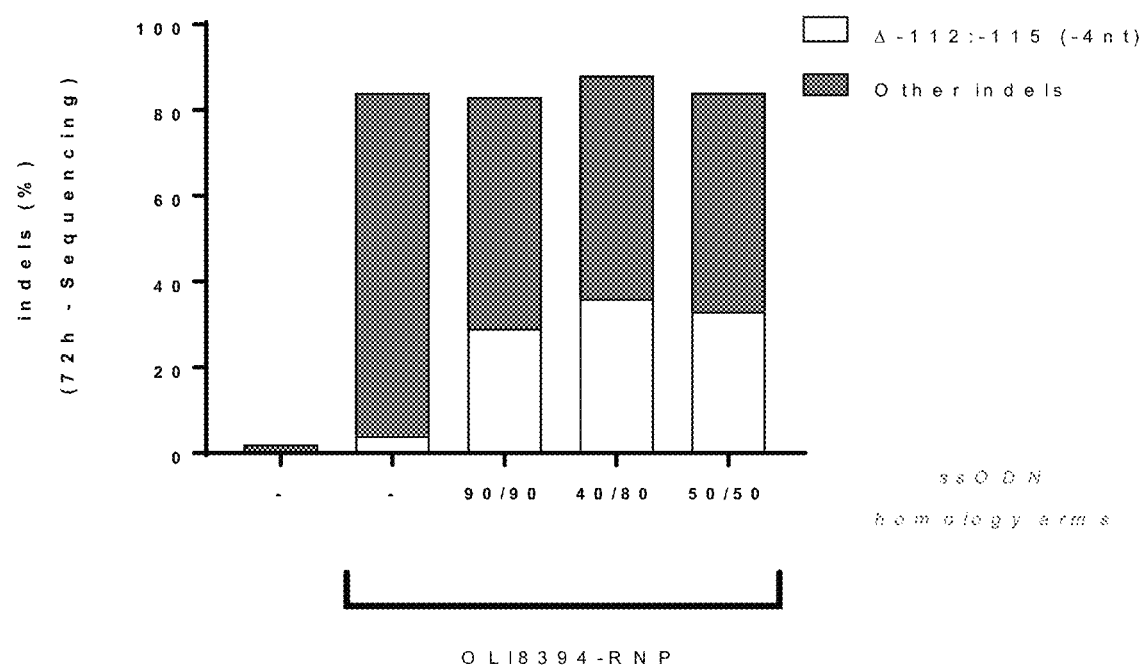

Example 10: Gene Correction in Human Hematopoietic Stem/Progenitor Cells can be Achieved with Short ssODN Templates with Symmetrical and Asymmetrical Homology Arms To determine whether gene correction could be achieved using templates shorter than the previously tested 180 nt lengths used in Example 9, ssODNs encoding the "4 nt" deletion (HBG Δ-112:-115) were designed and synthesized with shorter homology arms either symmetrical or asymmetrical relative to the deleted sequence (OLI16419-OLI16423, and OLI16425-OLI16429, Table 11, FIG. 23A). Briefly, mPB CD34+ cells were pre-stimulated for 2 days with human cytokines in X-Vivo-10 and then electroporated with a mixture composed of an ssODN donor (OLI16424, OLI16419 or OLI16421) at 2.5 µM and Cas9 protein precomplexed to OLI8394 (OLI8394-RNP) at 2 µM. After three days post electroporation the genomic DNA was extracted, and next-generation sequencing was performed on the HBG PCR products. Total editing and gene correction level were similar across ssODNs having symmetrical 90 nt homology arms, symmetrical 50 nt homology arms or 40/80 asymmetrical arms (FIG. 23B).

Example 11: Co-Delivery of ssODN Donors with Paired D10A-Cas9 RNPs to Adult CD34+ Cells Supports Gene Correction at the HBG Distal CCAAT Box To determine if ssODN-mediated gene correction to introduce CCAAT box disrupting deletions (such as, the "4nt" deletion) in mPB CD34+ cells could be supported by D10A nickase pairs, CD34+ cells were electroporated with D10A Cas9 RNPs targeting HBG, with or without ssODN (OLI16424) (Table 11). Briefly, Sp37 and SpA gRNA were chemically synthesized (OLI7075 and OLI7074, respectively, Table 12) and complexed with D10A-Cas9 nickase mutant protein. Human adult mPB CD34+ cells were pre-stimulated for 48 h in medium supplemented with human cytokines. Next, the D10A-Cas9 RNP pair comprising Sp37+SpA (2 µM+2 µM) was delivered to the CD34+ cells, alone or in combination with OLI16424, and genomic DNA was extracted 3 days post-electroporation for Illumina sequencing analysis.

TABLE 12 gRNA sequences for targeting the CCAAT box in CD34+ cells with D10A Cas9

| gRNA ID | OLI-ID | gRNA sequence (RNA) | gRNA sequence (DNA) |
|---|---|---|---|
| Sp37 | OLI17075 | CUUGACCAAUAGCCUUGACA GUUUUAGAGCUAGAAAUAGC AAGUUAAAAUAAGGCUAGUC CGUUAUCAACUUGAAAAAGU GGCACCGAGUCGGUGCUUUU (SEQ ID NO: 996) | CTTGACCAATAGCCTTGACAGTTT TAGAGCTAGAAATAGCAAGTTAA AATAAGGCTAGTCCGTTATCAAC TTGAAAAAGTGGCACCGAGTCGG TGCTTTT (SEQ ID NO: 998) |
| SpA | OLI17074 | GGCAAGGCUGGCCAACCCAU GUUUUAGAGCUAGAAAUAGC AAGUUAAAAUAAGGCUAGUC CGUUAUCAACUUGAAAAAGU GGCACCGAGUCGGUGCUUUU (SEQ ID NO: 997) | GGCAAGGCTGGCCAACCCATGTT TTAGAGCTAGAAATAGCAAGTTA AAATAAGGCTAGTCCGTTATCAA CTTGAAAAAGTGGCACCGAGTCG GTGCTTTT (SEQ ID NO: 999) |

Figure 24:
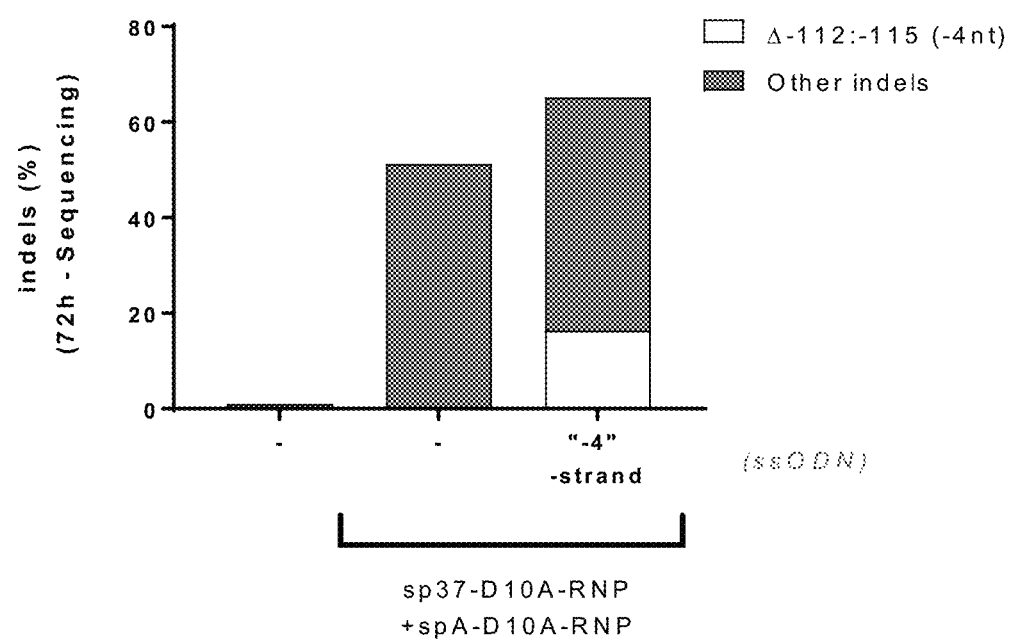
FIG. 24 depicts the percentage of indels detected by sequencing the HBG PCR product 72 hours after electroporation of mPB CD34+ cells with D10ACas9 complexed with Sp37 and SpA gRNAs (Table 12) ("sp37-D10A-RNP+spA-D10A-RNP") alone or with ssODN OLI16424 ("−4 nt− strand") (Table 11). The percentage of the precise −4 nt deletion (i.e., A-112:-115) is distinguished from other indels.

Co-delivery of the ssODN supported ~65% indels, instead of ~51% when the D10A-Cas9 RNP pair was delivered alone, as determined by sequencing of the HBG PCR product from genomic DNA (FIG. 24). Detailed sequencing analysis also demonstrated that 16% of the alleles carried the precise 4 nt deletion (HBG:Δ-112:-115) when the OLI16424 ssODN donor was co-delivered, whereas this deletion was undetected when the RNP pair was delivered alone. This indicated that ~25% of indels occurred by precise gene correction in the presence of the ssODN.

Example 12: Cpf1 RNP Containing gRNA Targeting the CCAAT Box Supports Gene Editing in Human Hematopoietic Stem/Progenitor Cells A Cpf1 guide RNA, HBG1-1 (i.e., OLI13620 (Table 13)), was designed to target the CCAAT box. To determine optimal nuclear localization signal configuration for *Acidaminococcus* sp. Cpf1 ("AsCpf1") delivery in CD34+ cells, HBG1-1 gRNA was complexed to two nuclear localization signal (NLS) variants of AsCpf1, namely His-AsCpf1-nNLS (SEQ ID NO: 1000) and His-AsCpf1-sNLS-sNLS (SEQ ID NO:1001). "His" refers to a six-histidine purification sequence, "AsCpf1" refers to the *Acidaminococcus* sp. Cpf1 protein sequence, "nNLS" refers to the nucleoplasmin NLS, and "sNLS" refers to the SV40 NLS.

Figure 25:
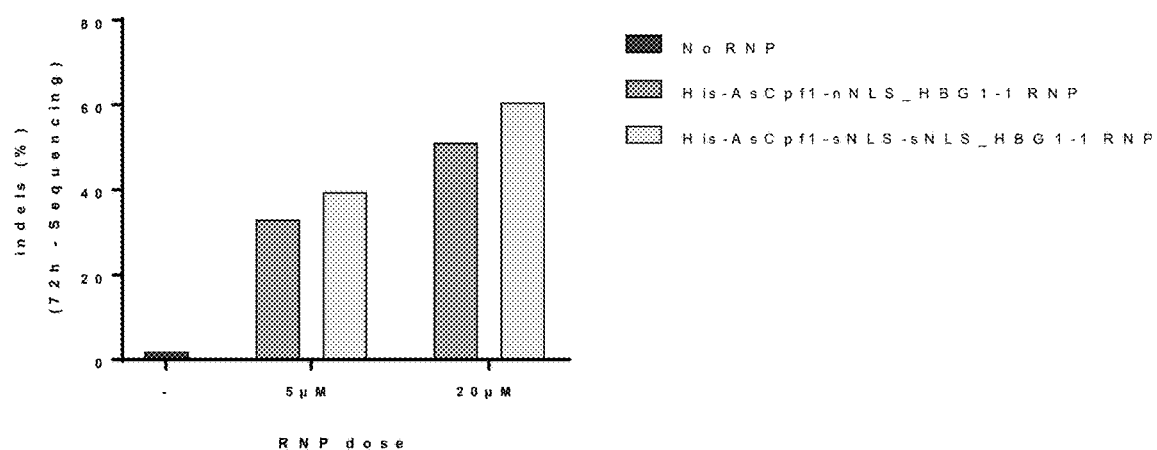
FIG. 25 depicts gene editing of HBG of mPB CD34+ cells electroporated with variants of *Acidaminococcus* sp. Cpf1 ("AsCpf1"), namely His-AsCpf1-nNLS (SEQ ID NO:1000) and His-AsCpf1-sNLS-sNLS (SEQ ID NO:1001) complexed with the guide RNA HBG1-1 (OLI13620) (Table 13)

Briefly, mPB CD34+ cells were pre-stimulated for 2 days with human cytokines in X-Vivo-10 and then electroporated with the RNPs at 5 μM or 20 μM. The genomic DNA was extracted three days post electroporation and next-generation sequencing was performed on the HBG PCR products. HBG1-1 gRNA complexed to either of the Cpf1 NLS variants tested ("His-AsCpf1-sNLS-sNLS_HBG1-1 RNP" or "His-AsCpf1-nNLS_HBG1-1 RNP"), supported editing of CD34+ cells at the 13 nt target site. His-AsCpf1-sNLS-sNLS_HBG1-1 RNP generated 60.6% edited alleles and His-AsCpf1-nNLS_HBG1-1 RNP generated 51.1% edited alleles at the highest dose tested (FIG. 25A).

TABLE 13

HBG1-1 gRNA sequence for targeting the CCAAT box in CD34+ cells

| gRNA ID | OLI-ID | Targeting domain sequence (RNA) | Targeting domain sequence (DNA) | Targeting domain sequence plus PAM (UUUG) (RNA) | Targeting domain sequence plus PAM (TTTG) (DNA) | Sense |
|---|---|---|---|---|---|---|
| HBG1-1 | OLI13620 | CCUUGUC AAGGCUA UUGGUC (SEQ ID NO: 1002) | CCTTGTC AAGGCTA TTGGTC (SEQ ID NO: 1003) | UUUGCCUUGU CAAGGCUAUU GGUC (SEQ ID NO: 1004) | TTTGCCTTG TCAAGGCT ATTGGTC (SEQ ID NO: 1005) | Antisense |

Example 13: Co-Delivery of Cpf1 RNP Targeting the CCAAT Box with ssODN Donors Supports Gene Editing in Human Hematopoietic Stem/Progenitor Cells RNP comprising HBG1-1 gRNA complexed to the His-AsCpf1-sNLS-sNLS variant ("His-AsCpf1-sNLS-sNLS_HBG1-1 RNP") were co-delivered by electroporation with single stranded oligodeoxynucleotide donor repair templates (ssODNs) to mPB CD34+ cells. As discussed in the examples above, OLI16430 and OLI16424 ssODNs were designed to "encode" a 4 nucleotide deletion and OLI16409 and OLI16410 ssODNs were designed to "encode" a 18 nucleotide deletion (Table 11). Both the 4 nt and 18 nt deletions disrupt the HBG distal CCAAT box and are associated with induction of HBG expression. The ssODNs include 90 nucleotide-long homology arms flanking the encoded absent sequence to create perfect deletion. The ssODNs were modified to contain phosphorothioates (PhTx) at the 5' and 3' ends (OLI16430, OLI16424, OLI16409, and OLI16410, Table 11). Briefly, human adult mPB CD34+ cells pre-stimulated for two days in medium supplemented with human cytokines were electroporated with 5 μM RNP comprising the His-AsCpf1-sNLS-sNLS protein complexed to HBG1-1 gRNA ("His-AsCpf1-sNLS-sNLS_HBG1-1 RNP") either alone, or in combination with 2.5 μM of one of the ssODN donors (OLI16430, OLI164324, OLI16409, or OLI16410). Co-delivery of the RNP and ssODN donor encoding the 18 nt deletion with positive strand homology arms (OLI16409) enhanced the editing frequency from 39.5% without donor to 73.3%, as determined by sequencing analysis of the HBG PCR product from genomic DNA extracted at 72 hours post-electroporation (FIG. 26A).

Further analysis of the specific type and size of deletions at the target site revealed that in the presence of the 18 nt positive strand donor (OLI16409), 57.3% of alleles carried the 18 nt deletion compared to 7.5% of alleles when the His-AsCpf1-sNLS-sNLS_HBG1-1 RNP was delivered alone (FIG. 26B). The ssODN co-delivery mediated precise repair of the DNA DSB because the 18 nt deletion represented 71.2% of all the indels generated with co-delivery of ssODN OLI16409 and His-AsCpf1-sNLS-sNLS_HBG1-1 RNP, whereas the 18 nt deletion represented only 19.0% of all the indels were generated when delivering His-AsCpf1-sNLS-sNLS_HBG1-1 RNP alone (FIG. 26C).

Although the data in FIGS. 26A-26C originally suggested that codelivery of Cpf1 RNP with ssODN donors increased precise gene editing of genomic DNA resulting in the 18 nt deletion, subsequent testing repeating the experiment in Example 13 confirmed that these data were an artifact of the experiment. Nonetheless, data acquired from the subsequent repeated experiments testing the AsCpf1 RNP using the guide RNA HBG1-1 and ssODN OLI16409 indicated that codelivery of an ssODN donor supports increased total editing in human mPB-CD34+ cells, although not associated with precise repair of the DNA DSB toward the "−18nt deletion" (see Example 21).

Example 14: Cpf1 RNP Containing gRNA Targeting the Distal CCAAT Box Region of the HBG Promoter Supports Gene Editing in Human Hematopoietic Stem/Progenitor Cells which Promotes Induction of HbF Protein Expression in the Erythroid Progeny Guide RNA HBG1-1 (Table 14) having a targeting domain comprising SEQ ID NO:1002 (Table 15), targets a site within the HBG promoter (FIG. 27A). The HBG1-1 gRNA (SEQ ID NO: 1022) was complexed to wild-type AsCpf1 (AsCpf1-sNLS-sNLS, SEQ ID NO:1001) to form an RNP ("AsCpf1-HBG1-1-RNP", Table 14). This complex (5 μM or 20 μM) was then electroporated into mobilized peripheral blood (mPB) derived CD34+ cells using either the Amaxa nucleofector (Lonza), or the MaxCyte GT (MaxCyte, Inc.) electroporation device. The level of insertions/deletions at the target site was analyzed by Illumina sequencing (NGS) of the PCR amplified target site three days after electroporation. AsCpf1-HBG1-1-RNP supported on-target editing of 43% and 17%, respectively, on the Amaxa and MaxCyte electroporation systems (FIGS. 28A (Amaxa) and 28B (MaxCyte)). Following the editing of mPB CD34+ cells, ex vivo differentiation into the erythroid linage was performed for 18 days (Giarratana 2011). Then, relative expression levels of gamma-globin chains (over total beta-like globin chains) was measured by UPLC (FIGS. 28A (Amaxa) and 28B (MaxCyte)). AsCpf1-HBG1-1-RNP led to an increase of gamma-globin expression by up to 21% above levels detected in cells derived from mock electroporated mPB CD34+ cells (FIG. 28A).

TABLE 14

| | | RNP components | | | |
|---|---|---|---|---|---|
| gRNA ID | Protein variant | RNP components | RNP ID | gRNA modification | gRNA sequence (RNA) |
| HBG1-1 gRNA | AsCpf1-SNLS-SNLS (SEQ ID NO: 1001) | gRNA + AsCpf1 WT | HBG1-1-AsCpf1-RNP | Synthetic unmodified | UAAUUUCUACUC UUGUAGAUCCUU GUCAAGGCUAUU GGUC (SEQ ID NO: 1022) |
| HBG1-1 gRNA | His-AsCpf1-SNLS-SNLS H800A (SEQ ID NO: 1032) | gRNA + AsCpf1 H800A | HBG1-1-AsCpf1H800 A-RNP | Synthetic unmodified | UAAUUUCUACUC UUGUAGAUCCUU GUCAAGGCUAUU GGUC (SEQ ID NO: 1022) |
| HBG1-1 gRNA | His-AsCpf1-SNLS-SNLS H800A (SEQ ID NO: 1032) | gRNA + AsCpf1 H800A | HBG1-1-AsCpf1H800 A-RNP | 5'OMe-PS2OMe | UAAUUUCUACUC UUGUAGAUCCUU GUCAAGGCUAUU GGmU/PS2/mC (SEQ ID NO: 1041) |
| tSpA dead gRNA | SpCas9WT (SEQ ID NO: 1033) | dead gRNA + SpCas9 WT | tSpA-Cas9-RNP | Synthetic 5'-3' 3xPSOMe | mG*mG*mC*UGG CCAACCCAUGU UUUAGAGCUAG AAAUAGCAAGU UAAAAUAAGGC UAGUCCGUUAU CAACUUGAAAA AGUGGCACCGA GUCGGUGCmU* mU*mU*U (SEQ ID NO: 1024) |
| SpA gRNA | His-NLS-SpCas9D10A (SEQ ID NO: 1034) | gRNA + SpCas9 nickase | SpA-D10A-RNP | Synthetic 5'-3' 3xPSOMe | mG*mG*mC*AAG GCUGGCCAACC CAUGUUUUAGA GCUAGAAAUAG CAAGUUAAAAU AAGGCUAGUCC GUUAUCAACUU GAAAAAGUGGC ACCGAGUCGGU |

TABLE 14-continued

| | | | | | RNP components |
|---|---|---|---|---|---|
| gRNA ID | Protein variant | RNP components | RNP ID | gRNA modification | gRNA sequence (RNA) |
| SpG gRNA | His-NLS-SpCas9D10A (SEQ ID NO: 1034) | gRNA + SpCas9 nickase | SpG-D10A-RNP | Synthetic 5'-3' 3xPSOMe | GCmU\*mU\*mU\*U (SEQ ID NO: 1025) mU\*mA\*mG\*UCU UAGAGUAUCCA GUGGUUUUAGA GCUAGAAAUAG CAAGUUAAAAU AAGGCUAGUCC GUUAUCAACUU GAAAAAGUGGC ACCGAGUCGGU GCmU\*mU\*mU\*U (SEQ ID NO: 1026) |
| Sp182 dead gRNA | SpCas9WT (SEQ ID NO: 1033) | dead gRNA + SpCas9 WT | Sp182-Cas9-RNP | Synthetic 5'-3' 3xPSOMe | mU\*mU\*mA\*GAG UAUCCAGUGGU UUUAGAGCUAG AAAUAGCAAGU UAAAAUAAGGC UAGUCCGUUAU CAACUUGAAAA AGUGGCACCGA GUCGGUGCmU\* mU\*mU\*U (SEQ ID NO: 1027) |

"His" refers to a six-histidine purification sequence
"AsCpf1" refers to the *Acidaminococcus* sp. Cpf1 protein sequence
"nNLS" refers to the nucleoplasmin NLS, and "sNLS" refers to the SV40 NLS
"SpCas9" refers to the *S. Pyogenes* Cas9 protein sequence
"\*" represents phosphorothioate modification
"PS" represents phosphorothioate modification
"PS2" represents phosphorodithioate modification
"OMe" represents a 2-o-methyl modification
"m" represents a 2-o-methyl modification

TABLE 15

Cpf1 guide RNA targeting sequences

| gRNA ID | gRNA Targeting domain sequence (RNA) | gRNA Targeting domain sequence (DNA) |
|---|---|---|
| HBG1-1 gRNA | CCUUGUCAAGGCUAUUGGUC (SEQ ID NO: 1002) | CCTTGTCAAGGCTATTGGTC (SEQ ID NO: 1003) |
| Sp182 dgRNA | UUAGAGUAUCCAGUG (SEQ ID NO: 1028) | TTAGAGTATCCAGTG (SEQ ID NO: 1029) |
| SpG gRNA | UAGUCUUAGAGUAUCCAGUG (SEQ ID NO: 359) | TAGTCTTAGAGTATCCAGTG (SEQ ID NO: 1030) |
| SpA gRNA | GGCAAGGCUGGCCAACCCAU (SEQ ID NO: 941) | GGCAAGGCTGGCCAACCCAT (SEQ ID NO: 944) |
| tSpA dgRNA | GGCUGGCCAACCCAU (SEQ ID NO: 326) | GGCTGGCCAACCCAT (SEQ ID NO: 1031) |

Example 15: Cpf1 RNP Editing Efficiency at the CCAAT Box Region of the HBG Promoter is Enhanced when Co-Delivered with *S. pyogenes* Cas9 RNP with No Impact on Viability It was hypothesized that the co-delivery of Cpf1-RNP with proximally targeting *S. pyogenes* Cas9 RNP, either catalytically inactive or introducing single nicks, could enhance editing levels at the target site. In an attempt to enhance Cpf1-RNP mediated editing at the distal CCAAT box region of the HBG promoter, HBG1-1-AsCpf1H800A-RNP (composed of His-AsCpf1-sNLS-sNLS-H800A (SEQ ID NO: 1032) complexed to HBG1-1 gRNA with a 3' modification as shown in Table 14 (SEQ ID NO:1041) was co-delivered into mPB CD34+ cells with: (1) *S. pyogenes* Cas9 D10A RNP containing a Cas9 D10A protein (His-NLS-SpCas9D10A, SEQ ID NO: 1034) complexed to a full length guide RNA (100mer) selected from: (a) SpA gRNA (Tables 14, 15; FIG. 27B) ("SpA-D10A-RNP", Table 14) or (b) SpG gRNA (Tables 14, 15; FIG. 27C) ("SpG-D10A-RNP", Table 14)); (2) *S. pyogenes* WT Cas9 RNP containing a WT Cas9 protein (SpCas9WT, SEQ ID NO:1033) complexed to a truncated dead guide RNA (95mer—with a shortened protospacer region) selected from (a) tSpA dgRNA (Tables 14, 15; FIG. 27E) ("tSpA-Cas9-RNP", Table 14); (b) Sp182 dgRNA (Tables 14, 15; FIG. 27F) ("Sp182-Cas9-RNP", Table 14); or (c) tSpA-Cas9-RNP and Sp182-Cas9-RNP (Tables 14, 15, FIG. 27D). The RNP complexes were electroporated using the MaxCyte GT device (MaxCyte, Inc). The level of insertions/deletions at the target site was then analyzed by Illumina sequencing (NGS) of the PCR amplified target site three days after electroporation. In all combinations tested, irrespective of the *S. pyogenes* Cas9 enzyme used (D10A or WT) and of PAM orientation, total editing was increased above levels observed following Maxcyte delivery of HBG1-1-AsCpf1H800A-RNP alone (FIG. 29 and Table 16). In addition there was no detrimental effect on viability of mPB CD34+ cells when *S. pyogenes* Cas9 RNP were co-delivered (FIG. 30).

TABLE 16

Summary of indels and gamma globin expression with each RNP combination at the maximum RNP dose tested

| Cpf1 RNP | Cas9 RNP1 | Cas9 RNP2 | Indels (NGS) | Gamma Globin (over total beta-like chains) |
|---|---|---|---|---|
| — | — | — | 0% | 13.5% |
| HBG1-1-AsCpf1H800A-RNP | — | — | 8.0% | 20.0% |
| HBG1-1-AsCpf1H800A-RNP | SpG-D10A-RNP | — | 88.6% | 30.2% |
| HBG1-1-AsCpf1H800A-RNP | SpA-D10A-RNP | — | 42.6% | 32.5% |
| HBG1-1-AsCpf1H800A-RNP | tSpA-Cas9-RNP | — | 32.2% | 19.8% |
| HBG1-1-AsCpf1H800A-RNP | Sp182-Cas9-RNP | — | 85.4% | 42.8% |
| HBG1-1-AsCpf1H800A-RNP | tSpA-Cas9-RNP | Sp182-Cas9-RNP | 80.1% | 33.7% |

Example 16: Cpf1 Editing Profile can be Manipulated with Co-Delivery of S. pyogenes Cas9-D10A-RNP In addition to the increase in total editing observed when HBG1-1-AsCpf1H800A-RNP was co-delivered to mPB CD34+ cells with S. pyogenes Cas9-D10A-RNP (FIG. 29), changes to the indel profile were also observed. The introduction of a single strand break proximal to the Cpf1-RNP target site by the D10A enzyme (FIG. 31A) altered the directionality, length and/or position of the indels (FIG. 31B). For example, Sp182-D10A-RNP strongly shifted the profile toward the nicking site introduced by the D10A RNP, with deletions of various length extending from the Cpf1 cut site toward the upstream nicking site (Sp182-D10A-RNP, FIG. 31B). While the SpA-D10A-RNP also promoted the generation of deletions extending from the HBG1-1-AsCpf1H800A-RNP cut site to the nicking site introduced by the D10A enzyme (here located downstream), in this case, additional deletions apparently originating from the nicking site, but not extending fully to the HBG1-1-AsCpf1H800A-RNP cut site, were also produced (SpA-D10A-RNP, FIG. 31B).

It is probable that the orientation, target strand, and distance of the S. pyogenes Cas9-D10A-RNP target site to the Cpf1-RNP target site leads to differences in the position and length of the mutations promoted by the additional DNA nick (FIG. 31A). It should be noted that in certain applications this directional manipulation of the indel profile, i.e., an increase in the frequency of indels occurring between the Cpf1-RNP and S. pyogenes Cas9 D10A-RNP binding sites, could be used to favor a desired editing outcome, to increase the rate of productive indels (e.g., indels disrupting a targeted site). In the case set-out within, to disrupt the dCCAAT target region and induce HbF protein expression, the co-delivery of HBG1-1-AsCpf1H800A-RNP with S. pyogenes D10A-RNP led to an increase of gamma globin levels by 16.7% (SpG-D10A-RNP) or 19.0% (SpA-D10A-RNP) above levels detected in mock electroporated cells, as detected by UPLC analysis after 18 days of erythroid differentiation post electroporation (FIG. 29 and Table. 16). The frequency of productive indels was higher when pairing HBG1-1-AsCpf1H800A-RNP with SpA-D10A-RNP (versus SpG-D10A-RNP) as a higher increase in HbF levels (19% with Cas9D10A-SpA-RNP vs 16.7% with SpG-D10A-RNP) was achieved from a lower editing level (42.6% with SpA-D10A-RNP vs 88.6% with SpG-D10A-RNP) (FIG. 29 and Table 16).

Example 17: Cpf1 Editing is Increased without Altering the Editing Profile in the Presence of S. pyogenes Cas9 WT RNP Containing a Dead Guide RNA When co-delivering HBG1-1-AsCpf1H800A-RNP (at a fixed dose of 6 µM) to mPB CD34+ cells with increasing doses of Sp182-Cas9-RNP (complexed with a truncated, 95mer dead gRNA, Sp182), using the MaxCyte electroporator device, an editing boost has been observed up to greater than 10-fold (85.4% editing with the highest dose of Sp182-Cas9-RNP versus 8.0% when HBG1-1-AsCpf1H800A-RNP was delivered alone) (FIG. 29). The levels of editing achieved here by co-delivering Sp182-Cas9-RNP also greatly surpassed the levels of editing obtained using the MaxCyte electroporator device when HBG1-1-AsCpf1H800A-RNP was delivered alone at doses as high as 20 uM (FIG. 28B). In contrast to the results observed by co-delivering a D10A-RNP (in Example 16), the increase in editing achieved by co-delivering HBG1-1-AsCpf1H800A-RNP with Sp182-Cas9-RNP (Cas9-WT complexed with a truncated gRNA) was not associated with an apparent impact on the indel profile. The indels detected in electroporated cells were centered around the Cpf1 cut site in an approximal symmetrical fashion and no indels were detected at the Sp182-Cas9-RNP target site (FIG. 32A). Of note, 96% of the total indels were disrupting the distal-CCAAT box, and 79.5% of total indels disrupted 3 or more nucleotides of the CCAAT box motif (FIG. 32B). Further dosing optimization using HBG1-1-AsCpf1H800A-RNP (composed of His-AsCpf1-sNLS-sNLS-H800A (SEQ ID NO:1032) complexed to HBG1-1 gRNA (SEQ ID NO:1022)) and Sp182-Cas9-RNP enabled editing levels of up to 92% in mPB-CD34+ cells at 120 hours post-electroporation using the MaxCyte device, and lead to gamma chain expression levels 32% above background in erythroid derived cells (41% of gamma chains in treated cells, 8% in mock treated cells) (FIG. 33). Those results demonstrate that an RNP composed of WT S. pyogenes Cas9 protein complexed with a truncated gRNA can increase the editing from a proximally binding Cpf1-RNP without introducing detectable levels of editing at its own binding site nor noticeably affecting the length nor directionality of indels generated by the Cpf1-RNP. Here, the editing enhancement provided by the Sp182-Cas9-RNP enables high editing of the HBG1-1-AsCpf1H800A-RNP at the HBG promoter, with a high frequency of indels disrupting the distal CCAAT box target motif and leading to therapeutically relevant levels of gamma chain expression in the bulk erythroid progeny of the electroporated cells.

Example 18: Clonal HbF Distribution within Cell Population Edited with Cpf1 gRNA Targeting the Distal CCAAT Box A single cell experiment was next performed to evaluate the distribution of gamma chain expression levels in erythroid cells derived from mPB CD34+ cells electroporated with the HBG1-1-AsCpf1H800A-RNP (composed of His-AsCpf1-sNLS-sNLS-H800A (SEQ ID NO: 1032) complexed to HBG1-1 gRNA with a 3' modification as shown in Table 14 (SEQ ID NO:1041))+Sp182-Cas9-RNP combination (FIG. 27F, Table 14). After being left to recover during 48 hours post-electroporation, the cells were sorted by Fluorescence Activated Cell Sorting (FACS) at 1-cell/well in non-tissue culture treated 384-well plates. The cells were then differentiated and expanded clonally for 18 days into the erythroid lineage (adapted from Giarratana 2011). UPLC analysis was performed to determine the distribution of gamma chain expression levels (percentage of gamma chains/[total beta-like chains]) in the clonal erythroid progeny of cells derived from the total population of mPB-CD34+ cells initially edited. It is considered that in order to achieve a functional benefit and alleviate symptoms associated with sickle cell disease, ~30% of the erythroid cells should have fetal hemoglobin levels greater than 30%. Of the clones analyzed, 83.1% had gamma chains levels above the median level detected in erythroid clones derived from mock electroporated mPB CD34+ cells (median value=18.8%), 64.2% had gamma chains levels exceeding 30% of total beta-like and 35.8% had gamma chains levels exceeding 48.8% of total beta-like (30%+18.8% median level in control cells) (FIG. 34).

Example 19: Screen of Cpf1 gRNAs Targeting the HBG Promoter Region

To identify other AsCpf1 gRNA that could be used as a component of a single RNP or in combination with a "booster element" to increase editing of the HBG promoter region in CD34+ cells and induce fetal globin expression in the erythroid progeny of modified cells, His-AsCpf1-NLS-NLS ("AsCpf1," SEQ ID NO:1000); AsCpf1 S542R/K607R ("AsCpf1 RR," SEQ ID NO: 1036); or AsCpf1 S542R/K548V/N552R ("AsCpf1 RVR," SEQ ID NO:1037) gRNA sequences targeting several domains of the HBG promoter (Table 17) were designed (listed in Table 18). AsCpf1 RR and AsCpf1 RVR are engineered AsCpf1 variants which recognize TYCV/ACCC/CCCC and TATV/RATR PAMs, respectively (Gao 2017).

TABLE 17

Subdomains of the HBG genomic region

| Genomic Coordinate of HbG* | Nucleotides | Name of Region |
|---|---|---|
| Chr 11 (NC_000011.10): 5,247,883-5,248,186 | TCCTAAAGCT TGGAACACTT TCCCTTCCTT AAGAACCATC CTTGCTACTC AGCTGCAATC AATCCAGCCC CCAGGTCTTC ACTGAACCTT TTCCCATCTC TTCCAAAACA TCTGTTTCTG AGAAGTCCTG TCCTATAGAG GTCTTTCTTC CCACCGGATT TCTCCTACAC CATTTACTCC CACTTGCAGA ACTCCCGTGT ACAAGTGTCT TTACTGCTTT TATTTGCTCA TCAAAATGCA CATCTCATAT AAAAATAAAT GAGGAGCATG CACACACCAC AAACACAAAC AGGCATGCAG AAAT (SEQ ID NO: 1118) | Region 1: Downstream of HBG1 |
| Chr 11 (NC_000011.10): 5,248,509-5,249,173 | ATAAAGATGA ACCCATAGTG AGCTGAGAGC TCCAGCCTGG CCTCCAGATA ACTACACACC AAGCTTCCAC CCAGAATCAA GCCTATGTTA ACTTCCCTCA AAGCCTGAGA TTTTGCCTTC CCATTAAATG CAGGTAGTTG TTCCCCTTCA AGCACTAGTC ACTGGCCATA ATTTAAATCT TGCTATCTTC TTGCCACCAT GAACCCTGTA TGTTGTAGGC TGAAGACGTT AAAAGAAACA CACGCTGACA CACACACACA CACGCGCGCG CGCACACACA CACACACACA CAGAGCTGAC TTTCAAAATC TACTCCAGCC CAAATGTTTC AATTGTTCCT CACCCCTGGA CATACTTTGC CCCCATCTGG AATTAAAGGA TATAAGTTTG TAATGAAGCA TTAGCAGCAT TTTATATGTG TCCAGCTGAT ATAGGAATAG CCTTAGCAAT GTATGTTTGG CCACCAAAGT TCCCCACTTT GACTGAGCCA ATATATGCCT TCTGCCTGCA TCTTTTTAAC GACCATACTT GTCCTGCCTC CAGATAGATG TTTTAAAACA ACAAAAATGA GGGAAAGATG AAAGTTCTTT CTACTGGAAT | Region 2: HBG1 Intron 2 - A |

TABLE 17-continued

Subdomains of the HBG genomic region

| Genomic Coordinate of HbG* | Nucleotides | Name of Region |
|---|---|---|
| | CTAATAAAGA AAAGTCATTT TCCTCATTTC CACCTCTCTT TTCTCAAAGT CAAAATTGTC CATCT (SEQ ID NO: 1119) | |
| Chr 11 (NC_000011.10): 5,249,198- 5,249,362 | CCCTAAAACA TTACCACTGG GTCTCAGCCC AGTTAGTCCT CTGCAGTTTC TTCACCCCCA ACCCCAGTAT CTTCAAACAG CTCACACCCT GCTGTGCTCA GATCAATACT CCGTTGTCTA AGTTGCCTCG AGACTAAAGG CAACAGGGCT GAAACATCTC CTGGA (SEQ ID NO: 1120) | Region 3: HBG1 Intron 2 - B |
| Chr 11 (NC_000011.10): 5,249,591- 5,249,712 | CTGTGAGATT GACAAGAACA GTTTGACAGT CAGAAGGTGC CACAAATCCT GAGAAGCGAC CTGGACTTTT GCCAGGCACA GGGTCCTTCC TTCCCTCCCT TGTCCTGGTC ACCAGAGCCT AC (SEQ ID NO: 1121) | Region 4: HBG1 Intron 1 |
| Chr 11 (NC_000011.10): 5,249,904- 5,249,927 | GCCGCCGGCC CCTGGCCTCA CTGG (SEQ ID NO: 1122) | Region 5: HBG1 -60 nt region from Transcription Start Site (TSS) |
| Chr 11 (NC_000011.10): 5,249,955- 5,249,987 | CCTTGTCAAG GCTATTGGTC AAGGCAAGGC TGG (SEQ ID NO: 1123) | Region 6: HBG1 -110 nt region from TSS |
| Chr 11 (NC_000011.10): 5,250,040- 5,250,075 | TGAGATAGTG TGGGGAAGGG GCCCCC AAGAGGATAC (SEQ ID NO: 1124) | Region 7: HBG1 -200 nt region from TSS |
| Chr 11 (NC_000011.10): 5,250,089- 5,250,129 | TATAGCCTTT GCCTTGTTCC GATTCAGTCA TTCCAGTTTT T (SEQ ID NO: 1125) | Region 8: HBG1 -250 nt region from TSS |
| Chr 11 (NC_000011.10): 5,250,141- 5,250,254 | TCTTCCCTTT AGCTAGTTTC CTTCTCCCAT CATAGAGGAT ACCAGGACTT CTTTTGTCAG CCGTTTTTTA CCTTCTTGTC TCTAGCTCCA GTGAGGCCTG TAGTTTAAAG CTAA (SEQ ID NO: 1126) | Region 9: HBG1 -333 nt region from TSS |
| Chr 11 (NC_000011.10): 5,250,464- 5,250,549 | CCACAGTTTC AGCGCAGTAA TAGATTAGTG TTACATAATA TAAGACCTAA TGCTTACCTC AATATCTACT TATCCGTACC TATTTG (SEQ ID NO: 1127) | Region 10: HBG1 -650 nt region from TSS |
| Chr 11 (NC_000011.10): 5,250,594- 5,250,735 | TATTCAGGTA TGTATGTATA CACCAGATGA TGTGTATTTA CCACTGGATA AGTGTGTGTG CTGGCTGATG ACCCAGGGTT TTGGCGTAGC TCTTCTATGC TCAGTAAAGA TGATGGTAGA ATGTTCTTTG GCAGGTACTG TG (SEQ ID NO: 1128) | Region 11: HBG1 -800 nt region from TSS |
| Chr 11 (NC_000011.10): 5,253,425- 5,254,121 | CAATAAAGAT GAACCCATAG TGAGCTGAGA GCTCCAGCCT GGCCTCCAGA TAACTACACA CCAAGCTTCC ACCCAGAATC | Region 12: HBG2 Intron 2 - A |

TABLE 17-continued

Subdomains of the HBG genomic region

| Genomic Coordinate of HbG* | Nucleotides | Name of Region |
|---|---|---|
| | AAGCCTATGT TAACTTCCCT<br>CAAAGCCTGA GATTTTGCTT<br>TCCCATTAAA TGCAGGTAGT<br>TGTTCTTCTT GCAGCACTAG<br>TCACTGGCCA TAATTTAAAT<br>CTTGTTATCT TCTTGCCACC<br>ATGAACCCTG TATGCTGTAG<br>GCTGAAAACG TTAAAAGAAA<br>CACACGCTCT CACACACACA<br>CAAACACACG CGCGCACACA<br>CACACACACA CACACAGAGC<br>TGACTTTCAA AATCTACTCC<br>AGCCCAAATG TTTCAATTGT<br>TCCTCACCCC TGGACATACT<br>TTGCCCCCAT CTGGAATTAA<br>AGGATATAAG TTTGTAATGA<br>AGCATTAGCA GCATTTTATA<br>TGTGTCCAGC TGATATAGGA<br>ATAGCCTTAG CAATGTATGT<br>TTGGCCACCA AAGTTCCCCA<br>CTTTGACTGA GCCAATATAT<br>GCCTTCTGCC TGCATCTTTT<br>TAATGACCAT ACTTGTCCTG<br>CCTCCAGATA GATGTTTTAA<br>AACGAATAAC AAAAATAGGG<br>GAAAGGTGAA AGTTCTTTCT<br>ACCGAAATCT AATAAAGAAA<br>AGTCATTTTC CTCATTTCCA<br>CCTCTCTTTT CTCAAAGTCA<br>AAGTTGTCCA TCTAGATTTT<br>CAGAGGCACT CCTTAGG<br>(SEQ ID NO: 1129) | |
| Chr 11<br>(NC_000011.10):<br>5,254,122-<br>5,254,306 | CCCTAAAACA TTGCCACTGG<br>GTCTCAGCCC AGTTAGTCCT<br>CTGCAGTTTC TTCACTCCCA<br>ACCCCAGTAT CTTCAAACAG<br>CTCACACCCT GCTGTGCTCA<br>GATCAATACT CAGTTGTCTA<br>AGTTGCCTCG AGACTAAAGG<br>CAACAGTGCT GAAACATCTC<br>CTGGACTCAC CTTGAAGTTC<br>TCAGG<br>(SEQ ID NO: 1130) | Region 13: HBG2 Intron 2 - B |
| Chr 11<br>(NC_000011.10):<br>5,254,511-<br>5,254,648 | AGCCTGTGAG ATTGACAAGA<br>ACAGTTTGAC AGTCAGAAGG<br>TGCCACAAAT CCTGAGAAGC<br>GACCTGGACT TTTGCCAGGC<br>ACAGGGTCCT TCCTTCCCTC<br>CCTTGTCCTG GTCACCAGAG<br>CCTACCTTCC CAGGGTT<br>(SEQ ID NO: 1131) | Region 14: HBG2 Intron 1 |
| Chr 11<br>(NC_000011.10):<br>5,254,829-<br>5,254,866 | CCGCCGGCCC CTGGCCTCAC<br>TGGATACTCT AAGACTAT<br>(SEQ ID NO: 1132) | Region 15: HBG2 -60 nt region from TSS |
| Chr 11<br>(NC_000011.10):<br>5,254,879-<br>5,254,909 | CCTTGTCAAG GCTATTGGTC<br>AAGGCAAGGC T<br>(SEQ ID NO: 1133) | Region 16: HBG2 -110 nt region from TSS |
| Chr 11<br>(NC_000011.10):<br>5,254,935<br>5,255,009 | CAGGGACCGT TTCAGACAGA<br>TATTTGCATT GAGATAGTGT<br>GGGGAAGGGG CCCCCAAGAG<br>GATACTGCTG CTTAA<br>(SEQ ID NO: 1134) | Region 17: HBG2 -200 nt region from TSS |
| Chr 11<br>(NC_000011.10):<br>5,255,025-<br>5,255,053 | TTGCCTTGTT CCGATTCAGT<br>CATTCCAAT<br>(SEQ ID NO: 1135) | Region 18: HBG2 -250 nt region from TSS |

TABLE 17-continued

Subdomains of the HBG genomic region

| Genomic Coordinate of HbG* | Nucleotides | Name of Region |
|---|---|---|
| Chr 11 (NC_000011.10): 5,255,076- 5,255,179 | TTTAGCTAGT TTTCTTCTCC CACCATAGAA GATACCAGGA CTTCTTTTGT CAGCCGTTTT TCACCTTCTT GTCTGTAGCT CCAGTGAGGC CTGTAGTTTA AAGT (SEQ ID NO: 1136) | Region 19: HBG2 -330 nt region from TSS |
| Chr 11 (NC_000011.10): 5,255,255- 5,255,292 | GGACACGTCT TAGTCTCATT TAGTAAGCAT TGGTTTCC (SEQ ID NO: 1137) | Region 20: HBG2 -500 nt region from TSS |
| Chr 11 (NC_000011.10): 5,255,518- 5,255,641 | TTTTTTATAT TCAGGTATGT ATGTAGGCAC CCGATGATGT GTATTTATCA CTGGATAAGT GTATGTGCTG GCTGATGACC CAGGGTTTTG GTGTAGCTCT TCTATGCTCG GTAAAGATGA TGGT (SEQ ID NO: 1138) | Region 21: HBG2 -800 nt region from TSS |

*NCBI Reference Sequence NC_000011, the coordinates are reported using the One-based coordinate system, "Homo sapiens chromosome 11, GRCh38.p12 Primary Assembly," (Version NC_000011.10).

TABLE 18

Cpf1 guide RNAs

| gRNA targeting domain sequence ID* | gRNA Targeting domain sequence (RNA) | gRNA Targeting domain sequence (DNA) | Genomic coordinates at HbG1** | Genomic coordinates at HbG2** | % Editing | Strand |
|---|---|---|---|---|---|---|
| AsCpf1 HBG1 Promoter-1 | AGACAGAUAU UUGCAUUGAG (SEQ ID NO: 1139) | AGACAGATAT TTGCATTGAG (SEQ ID NO: 1140) | Chr11:525002 4:5250043 | Chr11:52549 48:5254967 | 5.43 | + |
| AsCpf1 HBG1 Promoter-2 | CAUUGAGAUA GUGUGGGGA A (SEQ ID NO: 1141) | CATTGAGATA GTGTGGGGAA (SEQ ID NO: 1142) | Chr11:525003 7:5250056 | Chr11:52549 61:5254980 | 8.30 | + |
| AsCpf1 HBG1 Promoter-3 | UAGCCUUUGC CUUGUUCCGA (SEQ ID NO: 1143) | TAGCCTTTGC CTTGTTCCGA (SEQ ID NO: 1144) | Chr11:525009 1:5250110 | Chr11:52550 19:5255038 | 0.23 | + |
| AsCpf1 HBG1 Promoter-4 | CCUUGUUCCG AUUCAGUCAU (SEQ ID NO: 1145) | CCTTGTTCCG ATTCAGTCAT (SEQ ID NO: 1146) | Chr11:525010 0:5250119 | Chr11:52550 28:5255047 | 1.15 | + |
| AsCpf1 HBG1 Promoter-5 | UCUAAUUUAU UCUUCCCUUU (SEQ ID NO: 1147) | TCTAATTTATT CTTCCCTTT (SEQ ID NO: 1148) | Chr11:525013 1:5250150 | Chr11:52550 59:5255078 | 0.16 | + |
| AsCpf1 HBG1 Promoter-6 | CUUCUCCCAU CAUAGAGGAU (SEQ ID NO: 1149) | CTTCTCCCATC ATAGAGGAT (SEQ ID NO: 1150) | Chr11:525016 1:5250180 | | 12.73 | + |
| AsCpf1 HBG2 Promoter-7 | UUCUCCCACC AUAGAAGAU A (SEQ ID NO: 1151) | TTCTCCCACC ATAGAAGATA (SEQ ID NO: 1152) | | Chr11:52550 90:5255109 | 8.11 | + |

TABLE 18-continued

Cpf1 guide RNAs

| gRNA targeting domain sequence ID* | gRNA Targeting domain sequence (RNA) | gRNA Targeting domain sequence (DNA) | Genomic coordinates at HbG1** | Genomic coordinates at HbG2** | % Editing | Strand |
|---|---|---|---|---|---|---|
| AsCpf1 HBG1 Promoter-8 | CCACUGGAUA AGUGUGUGU G (SEQ ID NO: 1153) | CCACTGGATA AGTGTGTGTG (SEQ ID NO: 1154) | Chr11:525063 4:5250653 | | 13.33 | + |
| AsCpf1 HBG1 Promoter-9 | GCGUAGCUCU UCUAUGCUCA (SEQ ID NO: 1155) | GCGTAGCTCT TCTATGCTCA (SEQ ID NO: 1156) | Chr11:525067 7:5250696 | | 13.48 | + |
| AsCpf1 HBG1 Promoter-10 | CUGAGCAUAG AAGAGCUACG (SEQ ID NO: 1157) | CTGAGCATAG AAGAGCTACG (SEQ ID NO: 1158) | Chr11:525067 8:5250697 | | 10.73 | − |
| AsCpf1 HBG2 Promoter-11 | UCACUGGAUA AGUGUAUGU G (SEQ ID NO: 1159) | TCACTGGATA AGTGTATGTG (SEQ ID NO: 1160) | | Chr11:52555 65:5255584 | 0.43 | + |
| AsCpf1 HBG2 Promoter-12 | GUGUAGCUCU UCUAUGCUCG (SEQ ID NO: 1161) | GTGTAGCTCT TCTATGCTCG (SEQ ID NO: 1162) | | Chr11:52556 08:5255627 | 5.78 | + |
| AsCpf1 HBG2 Promoter-13 | CCGAGCAUAG AAGAGCUACA (SEQ ID NO: 1163) | CCGAGCATAG AAGAGCTACA (SEQ ID NO: 1164) | | Chr11:52556 09:5255628 | 3.24 | − |
| HBG1-1 AsCpf1 | CCUUGUCAAG GCUAUUGGUC (SEQ ID NO: 1002) | CCTTGTCAAG GCTATTGGTC (SEQ ID NO: 1003) | Chr11:524995 5:5249974 | Chr11:52548 79:5254898 | 17.96 | + |
| AsCpf1 RR HBG1 Promoter-1 | GACAGAUAUU UGCAUUGAGA (SEQ ID NO: 1167) | GACAGATATT TGCATTGAGA (SEQ ID NO: 1168) | Chr11:525002 5:5250044 | Chr11:52549 49:5254968 | 8.48 | + |
| AsCpf1 RR HBG1 Promoter-2 | ACACUAUCUC AAUGCAAAUA (SEQ ID NO: 1169) | ACACTATCTC AATGCAAATA (SEQ ID NO: 1170) | Chr11:525003 1:5250050 | Chr11:52549 55:5254974 | 0.09 | − |
| AsCpf1 RR HBG1 Promoter-3 | CACACUAUCU CAAUGCAAAU (SEQ ID NO: 1171) | CACACTATCT CAATGCAAAT (SEQ ID NO: 1172) | Chr11:525003 2:5250051 | Chr11:52549 56:5254975 | 2.10 | − |
| AsCpf1 RR HBG1 Promoter-4 | CCACACUAUC UCAAUGCAAA (SEQ ID NO: 1173) | CCACACTATC TCAATGCAAA (SEQ ID NO: 1174) | Chr11:525003 3:5250052 | Chr11:52549 57:5254976 | 2.52 | − |
| AsCpf1 RR HBG1 Promoter-5 | UUCCCACAC UAUCUCAAUG (SEQ ID NO: 1175) | TTCCCCACAC TATCTCAATG (SEQ ID NO: 1176) | Chr11:525003 7:5250056 | Chr11:52549 61:5254980 | 0.05 | − |
| AsCpf1 RR HBG1 Promoter-6 | GAUUCAGUCA UUCCAGUUUU (SEQ ID NO: 1177) | GATTCAGTCA TTCCAGTTTT (SEQ ID NO: 1178) | Chr11:525010 9:5250128 | | 0.77 | + |
| AsCpf1 RR HBG1 Promoter-7 | AUUCAGUCAU UCCAGUUUUU (SEQ ID NO: 1179) | ATTCAGTCAT TCCAGTTTTT (SEQ ID NO: 1180) | Chr11:525011 0:5250129 | | 0.24 | + |

TABLE 18-continued

Cpf1 guide RNAs

| gRNA targeting domain sequence ID* | gRNA Targeting domain sequence (RNA) | gRNA Targeting domain sequence (DNA) | Genomic coordinates at HbG1** | Genomic coordinates at HbG2** | % Editing | Strand |
|---|---|---|---|---|---|---|
| AsCpf1 RR HBG1 Promoter-8 | GUCAUUCCAG UUUUUCUCUA (SEQ ID NO: 1181) | GTCATTCCAG TTTTTCTCTA (SEQ ID NO: 1182) | Chr11:525011 5:5250134 | | 1.00 | + |
| AsCpf1 RR HBG1 Promoter-9 | AGUUUUUCUC UAAUUUAUUC (SEQ ID NO: 1183) | AGTTTTTCTCT AATTTATTC (SEQ ID NO: 1184) | Chr11:525012 3:5250142 | | 0.15 | + |
| AsCpf1 RR HBG1 Promoter-10 | GUUUUUCUCU AAUUUAUUCU (SEQ ID NO: 1185) | GTTTTTCTCTA ATTTATTCT (SEQ ID NO: 1186) | Chr11:525012 4:5250143 | | 0.15 | + |
| AsCpf1 RR HBG2 Promoter-11 | GAUUCAGUCA UUCCAAUUUU (SEQ ID NO: 1187) | CAAGAGGATA CTGCTGCTTA (SEQ ID NO: 1188) | | Chr11:52549 89:5255008 | *** | + |
| AsCpf1 RR HBG2 Promoter-12 | AUUCAGUCAU UCCAAUUUUU (SEQ ID NO: 1189) | AAGAGGATAC TGCTGCTTAA (SEQ ID NO: 1190) | | Chr11:52549 90:5255009 | *** | + |
| AsCpf1 RR HBG2 Promoter-13 | GUCAUUCCAA UUUUUCUCUA (SEQ ID NO: 1191) | GATTCAGTCA TTCCAATTTT (SEQ ID NO: 1192) | | Chr11:52550 37:5255056 | 0.25 | + |
| AsCpf1 RR HBG2 Promoter-14 | AAUUUUUCUC UAAUUUAUUC (SEQ ID NO: 1193) | ATTCAGTCAT TCCAATTTTT (SEQ ID NO: 1194) | | Chr11:52550 38:5255057 | 0.13 | + |
| AsCpf1 RR HBG2 Promoter-15 | AUUUUUCUCU AAUUUAUUCU (SEQ ID NO: 1195) | GTCATTCCAA TTTTTCTCTA (SEQ ID NO: 1196) | | Chr11:52550 43:5255062 | 0.32 | + |
| AsCpf1 RR HBG2 Promoter-16 | UUCUCCCAUC AUAGAGGAU A (SEQ ID NO: 1197) | AATTTTTCTCT AATTTATTC (SEQ ID NO: 1198) | | Chr11:52550 51:5255070 | 0.14 | + |
| AsCpf1 RR HBG2 Promoter-17 | AUCAUAGAGG AUACCAGGAC (SEQ ID NO: 1199) | ATTTTTCTCTA ATTTATTCT (SEQ ID NO: 1200) | | Chr11:52550 52:5255071 | 0.10 | + |
| AsCpf1 RR HBG1 Promoter-18 | ACCAUAGAAG AUACCAGGAC (SEQ ID NO: 1201) | TTCTCCCATC ATAGAGGATA (SEQ ID NO: 1202) | Chr11:525016 2:5250181 | | 1.40 | + |
| AsCpf1 RR HBG1 Promoter-19 | CAGUACCUGC CAAAGAACAU (SEQ ID NO: 1203) | ATCATAGAGG ATACCAGGAC (SEQ ID NO: 1204) | Chr11:525016 9:5250188 | | 7.88 | + |
| AsCpf1 RR HBG2 Promoter-20 | UAGUAUCUGG UAAAGAGCAU (SEQ ID NO: 1205) | ACCATAGAAG ATACCAGGAC (SEQ ID NO: 1206) | | Chr11:52550 97:5255116 | 13.03 | + |
| AsCpf1 RR HBG1 Promoter-21 | UCAAUGCAAA UAUCUGUCUG (SEQ ID NO: 1207) | CAGTACCTGC CAAAGAACAT (SEQ ID NO: 1208) | Chr11:525071 4:5250733 | | 13.31 | − |

TABLE 18-continued

Cpf1 guide RNAs

| gRNA targeting domain sequence ID* | gRNA Targeting domain sequence (RNA) | gRNA Targeting domain sequence (DNA) | Genomic coordinates at HbG1** | Genomic coordinates at HbG2** | % Editing | Strand |
|---|---|---|---|---|---|---|
| AsCpf1 RR HBG2 Promoter-22 | CUCUUGGGGG CCCCUUCCCC (SEQ ID NO: 1209) | TAGTATCTGG TAAAGAGCAT (SEQ ID NO: 1210) |  | Chr11:52556 45:5255664 | 4.07 | - |
| AsCpf1 RVR HBG1 Promoter-1 | GAUUCAGUCA UUCCAAUUUU (SEQ ID NO: 1211) | TCAATGCAAA TATCTGTCTG (SEQ ID NO: 1212) | Chr11:525002 3:5250042 | Chr11:52549 47:5254966 | 0.15 | - |
| AsCpf1 RVR HBG1 Promoter-2 | AUUCAGUCAU UCCAAUUUUU (SEQ ID NO: 1213) | CTCTTGGGGG CCCCTTCCCC (SEQ ID NO: 1214) | Chr11:525005 1:5250070 | Chr11:52549 75:5254994 | 1.09 | - |
| AsCpf1 RVR HBG1 Promoter-3 | AAAAAAAUU AGCAGUAUCC U (SEQ ID NO: 1215) | AAAAAAATTA GCAGTATCCT (SEQ ID NO: 1216) | Chr11:525006 9:5250088 |  | *** |  |
| AsCpf1 RVR HBG1 Promoter-4 | GCCUUUGCCU UGUUCCGAUU (SEQ ID NO: 1217) | GCCTTTGCCTT GTTCCGATT (SEQ ID NO: 1218) | Chr11:525009 3:5250112 | Chr11:52550 21:5255040 | 3.96 | + |
| AsCpf1 RVR HBG2 Promoter-5 | AAAAAAAUU AAGCAGCAGU A (SEQ ID NO: 1219) | AAAAAAATTA AGCAGCAGTA (SEQ ID NO: 1220) |  | Chr11:52549 97:5255016 | *** | - |
| AsCpf1 RVR HBG1 Promoter-6 | CUCAGUAAAG AUGAUGGUA G (SEQ ID NO: 1221) | CTCAGTAAAG ATGATGGTAG (SEQ ID NO: 1222) | Chr11:525069 3:5250712 |  | 5.32 | + |
| AsCpf1 RVR HBG2 Promoter-7 | ACUGGAUAAG UGUAUGUGCU (SEQ ID NO: 1223) | ACTGGATAAG TGTATGTGCT (SEQ ID NO: 1224) |  | Chr11:52555 67:5255586 | 9.78 | + |
| AsCpf1 RVR HBG2 Promoter-8 | UGCUGGCUGA UGACCCAGGG (SEQ ID NO: 1225) | TGCTGGCTGA TGACCCAGGG (SEQ ID NO: 1226) | Chr11:525065 2:5250671 | Chr11:52555 83:5255602 | 0.24 | + |
| AsCpf1 RVR HBG2 Promoter-9 | CUCGGUAAAG AUGAUGGUA G (SEQ ID NO: 1227) | CTCGGTAAAG ATGATGGTAG (SEQ ID NO: 1228) |  | Chr11:52556 24:5255643 | 5.75 | + |
| AsCpf1 RVR HBG2 Promoter-10 | UGGUAAAGA GCAUUCUACC A (SEQ ID NO: 1229) | TGGTAAAGAG CATTCTACCA (SEQ ID NO: 1230) |  | Chr11:52556 38:5255657 | 8.55 | - |

*the gRNA ID name provides the particular Cpf1 molecule used in the RNP complex
**NCBI Reference Sequence NC_000011, the coordinates are reported using the One-based coordinate system, "Homo sapiens chromosome 11, GRCh38.p12 Primary Assembly," (Version NC_000011.10).
***represents gRNAs that were not tested.

RNPs (5 μM) containing AsCpf1 protein (SEQ ID NO: 1000), AsCpf1 RR protein (SEQ ID NO: 1036), or AsCpf1 RVR (SEQ ID NO: 1037) complexed with single gRNAs comprising gRNA targeting domains from Table 18 (see gRNA ID name for the particular Cpf1 molecule used) were delivered to mobilized peripheral blood (mPB) CD34+ cells using the Amaxa electroporator device (Lonza). After 72 hours, genomic DNA was extracted from cells and the level of insertions/deletions at the target site was then analyzed by Illumina sequencing (NGS) of the PCR amplified target site. The percentage of editing (indels=deletions and insertions) for each gRNA is shown in Table 18 above. In certain embodiments, Cpf1 RNPs comprising one or more of the gRNAs set forth in Table 18 may be used to target the regions listed in Table 17 to induce HbF expression and may be co-delivered with a "booster element" to achieve higher editing levels compared to the editing level of the Cpf1 RNP alone.

Example 20: Co-Delivery of HBG1-1-Cpf1 RNP Targeting the CCAAT Box with ssODN Supports an Increase in Gene Editing in Human Hematopoietic Stem/Progenitor Cells Having demonstrated that a 100 nt ssODN (50/50 homology) donor template encoding the "4 nt deletion" (HBG Δ-112:-115) co-delivered with Cas9 RNP generated a comparable outcome to the longer 180 nt templates (Example 10 and FIG. 23), a 100 nt ssODN generating the "18 nt deletion" (HBG Δ-104:-121) (i.e., ssODN OLI16431 (SEQ ID NO: 1040), Table 11) was co-delivered with Cpf1 RNP to further investigate the editing outcome.

Briefly, human adult mPB CD34+ cells pre-stimulated for two days in medium supplemented with human cytokines were electroporated with RNP comprising the His-AsCpf1-sNLS-sNLS H800A protein (SEQ ID NO:1032, Table 14) complexed to modified HBG1-1 gRNA (SEQ ID NO:1041, Table 14) ("His-AsCpf1-sNLS-sNLS H800A_HBG1-1 RNP") either alone at 6 µM or in combination with OLI16431 (0.5-6 µM). Co-delivery of the RNP and ssODN donor encoding the 18 nt deletion with positive strand homology arms (OLI16431) enhanced the editing frequency from 8.0% without donor to 75.6%, as determined by sequencing analysis of the HBG PCR product from genomic DNA extracted at 72 hours post-electroporation (FIG. 35A). This level of editing enabled an increase in HbF levels of ~24% above background (FIG. 35A). Additionally, it should be noted that there was no decrease observed in cell viability (FIG. 35B) as measured by DAPI exclusion or of colony forming potential (FIG. 35C) at any of the doses tested.

Example 21: Optimization of HBG1-1-Cpf1 RNP and OLI16431 Dosing to Maximize Editing at the RNP Targeting Distal CCAAT Box Site Having demonstrated increased editing when co-delivering ssODN with RNP (Examples 9-11, 13, 20), the same methodology was used to optimize the dosing of each component in order to maximize total editing. Briefly, a dosing matrix was set up with RNP comprising the His-AsCpf1-sNLS-sNLS H800A protein (SEQ ID NO: 1032, Table 14) complexed to unmodified HBG1-1 gRNA (SEQ ID NO:1022, Table 14) ("His-AsCpf1-sNLS-sNLS H800A_HBG1-1 RNP") being co-delivered at 0-12 µM with OLI16431 (SEQ ID NO:1040, Table 11) at 0-12 µM. Using a dose of 8 µM His-AsCpf1-sNLS-sNLS H800A_HBG1-1 RNP co-delivered with 8 µM OLI16431, a maximum of 89.4% indels was achieved when measured by sequencing analysis of the HBG PCR product from genomic DNA extracted from cells following 14 days erythroid culture (FIG. 36A). This coincided with an increase in HbF levels to >32% above background under these dosing conditions (FIG. 36A). The viability of this sample (His-AsCpf1-sNLS-sNLS H800A_HBG1-1 RNP [8 µM]+OLI16431 [8 µM]) was comparable to that of the untreated control sample at both 48 hours post electroporation and after 14 days in erythroid culture (FIG. 36B).

However, as eluded to in Example 13, an artifact was observed when >8 µM OLI16431 was electroporated into the cells alone, without RNP. Under these conditions, there was a false positive result when PCR amplification was performed 48 hour post electroporation, likely due to excessive ssODN within the system (see FIG. 36A, 8 µM and 12 µM for OLI16431 alone at 48 hours (black bars)). At lower doses of ssODN, and at later timepoints, this false positive was no longer apparent (FIG. 36A, 4 µM and 6 µM for OLI16431 alone at 48 hours (black bars) and 4 µM, 6 µM, 8 µM, and 12 µM for OLI16431 alone at 14 days (light grey bars)). In addition, the decrease in cell viability observed with the ssODN alone groups (FIG. 36B, dropping to ~57% with 12 µM OLI16431 alone at 48 hours (black bars)) may be a compounding factor. That there was no false positive result at ssODN doses of 4 µM and 6 µM suggests that this artifact may be due to excessive ssODN. These factors, along with the baseline HbF levels observed with the 8 µM and 12 µM OLI16431 alone groups (FIG. 36A, grey dots as compared to negative control), provide confidence that the substantial and sustained boost in RNP editing with the addition of ssODN is real and not an artifact.

Example 22: RNPs Containing Various Cpf1 and gRNA Targeting the HBG Promoter Region Support Gene Editing in Human Hematopoietic Stem/Progenitor Cells which Promotes Induction of HbF Protein Expression in the Erythroid Progeny Guide RNAs comprising SEQ ID NOs:1022, 1023, 1041-1093, 1098-1106 (Table 19) were complexed to various Cpf1 variant enzymes (SEQ ID NOs:1032, 1094-1097, 1107-1109, Table 20) to form various RNP complexes (Table 21). The RNPs contained gRNAs with modifications to the 5' end and/or modifications to the 3' end of the gRNA (Table 19). Guide RNAs comprising SEQ ID NOs:1022, 1023, 1041-1084, 1098-1106 (Table 19) have the same expected cleavage site at the distal CCAAT box target region, the related targeting domains contain the sequences set forth in SEQ ID NO:1002 (HBG1-1), SEQ ID NO:1254 (HBG1-1-21mer), SEQ ID NO:1256 (HBG1-1-22mer), SEQ ID NO:1258 (HBG1-1-23mer), for gRNA comprising a 20 mer, 21 mer, 22 mer, or 23 mer protospacer sequence respectively (Table 22, Table 23). In some cases gRNA targeting other positions within the HBG promoter were also tested, including guide RNAs SEQ ID NOs:1085-1096, comprising targeting domains containing the sequences set forth in SEQ ID NOs:1260 (AsCpf1 HBG1 Promoter-1 (21mer)), SEQ ID NO:1262 (AsCpf1 HBG1 Promoter-2 (21mer)) or SEQ ID NO:1264 (AsCpf1 HBG1 Promoter-6 (21mer)) (Table 22, Table 23). Table 21 provides a listing of each RNP tested in Examples 22-24 and the SEQ ID NO of the gRNA and the SEQ ID NO of the Cpf1 variant that form each RNP complex. Additional information about each gRNA and Cpf1 variant may be found in Table 19 and Table 20, respectively.

The gRNAs used in Examples 22 and 23 were chemically synthesized. Chemicals for oligonucleotide synthesis were purchased from BioAutomation, Glen Research, Millipore Sigma, Sigma-Aldrich, ChemGenes, and Thermo Fisher Scientific. The solid support used for synthesis was either a Unylinker 2000 Å CPG resin, a 2'-TBDMS rU 2000 Å CPG resin or a 2'-O-methyl adenosine (N-Bz) lcaa 2000 Å CPG resin from ChemGenes. RNA (TBDMS-protected) and DNA phosphoramidites were obtained from Thermo Fisher Scientific. In certain embodiments, phosphorothioates were introduced during a sulfurization step with a solution of DDTT (3-((dimethylamino-methylidene)amino)-3H-1,2,4-dithiazole-3-thione) from Glen Research. Oligonucleotides were synthesized using standard RNA and DNA phosphoramidite chemistry on either a BioAutomation MerMade 12 synthesizer or on a GE Äkta OligoPilot 100 synthesizer. Following synthesis, the oligonucleotides were cleaved from the solid support and deprotected in a two-step process using ammonium hydroxide/methylamine and TEA-3HF. After desalting, the oligonucleotides were purified using reversed-phase chromatography on a preparative HPLC.

First, the effect of editing using RNPs comprising gRNAs with modifications to the 5' end of the gRNAs was tested. Briefly, RNP complexes (6.0 µM and 12 µM) were delivered to 1×10⁶ mPB CD34+ cells via MaxCyte electroporation, following 48 hours pre-stimulation in X-Vivo 10 media supplemented with SCF, TPO and FLT3. The level of insertions/deletions at the target site was analyzed by Illumina sequencing (NGS) of the PCR amplified target site at 72 hours after electroporation. Results demonstrate that RNPs comprising gRNAs with no modification (RNP33, also referred to as "HBG1-1-AsCpf1 RNP," Table 14) or modifications to the 5' end of the gRNA including the addition of 5 nt RNA (RNP37), 10 nt RNA (RNP38), 25 nt RNA (RNP39), 60 nt RNA (RNP40), 5 nt DNA (RNP41), 10 nt DNA (RNP42), 25 nt DNA (RNP43), and 60 nt DNA (RNP44) (Table 21) supports on-target editing (FIG. 37).

Next, the effect of co-delivery of Cpf1 RNP with Sp182 dead RNP (dead gRNA comprising SEQ ID NO: 1027 (Table 14) complexed with *S. pyogenes* Cas9 (SEQ ID NO:1033)) or ssODN OLI16431 (SEQ ID NO:1040, Table 11) was tested. Briefly, a dosing matrix with RNP33 (no 5' or 3' gRNA modification, Table 21) complexes at varying concentrations (6 µM, 8 µM, 8 µM, and 12 µM) were co-delivered with Sp182 RNP (8 µM, 8 µM, 6 µM, and 4 µM) or ssODN OLI16431 (8 µM, 8 µM, 6 µM, and 4 µM) to 5.25×10⁶ mPB CD34+ cells via MaxCyte electroporation, following 48 hours pre-stimulation in X-Vivo 10 media supplemented with SCF, TPO and FLT3. Following electroporation, cells were placed back to culture for a further 48 hours. Then, a fraction of the CD34 cells were split for gDNA extraction and indel quantification in the bulk cell population. In addition, to investigate the editing in phenotypic progenitors and phenotypic hematopoietic stem cells (HSCs), HSPC subpopulations were characterized (amongst the remainder CD34 cells) by immune-phenotyping (Notta 2011) and separated by fluorescence Activated Cell Sorting (FACS). Immune phenotyping at 48 hours post electroporation was performed by staining cells with antibodies against hCD34, hCD38, hCD45RA, hCD90, and hCD123. Phenotypic HSCs were defined as hCD34bright hCD38 hCD90+hCD45RA-, and progenitors were defined as hCD34bright CD38+. These two populations were sorted by FACS and DNA was extracted to determine the editing levels in these sub-populations. The level of insertions/deletions at the target site was analyzed by Illumina sequencing (NGS) of the PCR amplified target. Results demonstrate that RNP33 co-delivered with the "booster elements" Sp182 RNP or ssODN OLI16431 support on-target editing (FIGS. 38A-B) at levels higher than those observed when delivering RNP33 alone (FIG. 37).

Next, the effect of co-delivery of RNP33 (no 5' or 3' gRNA modification, Table 21), RNP43 (+25 DNA 5' gRNA modification, Table 21) or RNP34 (1×PS2-OMe+1×OMe 3' gRNA modifications, Table 21) with Sp182 dgRNA (Table 15) or ssODN OLI16431 (Table 11) was tested. Briefly, RNP33, RNP34, or RNP43 complexes (8 µM) were co-delivered with Sp182 RNP (8 µM) or ssODN OLI16431 (8 µM) to 5.25×10⁶ mPB CD34+ cells via MaxCyte electroporation, following 48 hours pre-stimulation in X-Vivo 10 media supplemented with SCF, TPO and FLT3. Following electroporation, cells were placed back to culture for a further 48 hours prior to sorting into phenotypic progenitor and phenotypic HSC fractions for indel quantification. The level of insertions/deletions at the target site was analyzed by Illumina sequencing (NGS) of the PCR amplified target site at 48 hours after electroporation. Results demonstrate that RNPs containing gRNAs with 5' modification or 3' modifications co-delivered with the "booster elements" Sp182 RNP or ssODN OLI16431 support on-target editing (FIG. 39). Both booster elements tested provided comparable editing levels to RNP34 and RNP33. When compared to editing levels obtained without the booster element, while RNP33 editing was enhanced by both booster elements, RNP43 editing was however only increased with the addition of Sp182 RNP (FIGS. 37, 39).

Next the effect of different Cpf1 proteins on RNP editing was tested. A stoichiometric comparison (gRNA:Cpf1) with RNPs comprising various Cpf1 proteins was performed. Briefly, RNPs (RNP64, RNP63, RNP45, Table 21) were delivered at a stoichiometry (gRNA:Cpf1 complexation ratio) of either 2 or 4, where the gRNA is in a molar excess. All RNPs were delivered via MaxCyte electroporation at 8 µM to 1×10⁶ CD34+ cells following 48 hours pre-stimulation in X-Vivo 10 media supplemented with SCF, TPO and FLT3. Following electroporation, cells were placed back to culture for a further 72 hours prior to indel quantification. Results demonstrated that there was no difference in editing rates with altered stoichiometry at the concentration tested (FIG. 40). RNP45 (comprising Cpf1 protein SEQ ID NO:1094) outperforms RNP63 (comprising Cpf1 protein SEQ ID NO:1095) and RNP64 (comprising Cpf1 SEQ ID NO:1109).

Next, the effect of Sp182 RNP or ssODN OLI16431 co-delivery with various RNPs containing different Cpf1 proteins was tested. Briefly, RNPs (RNP33, RNP64, RNP63, RNP45, Table 21) were delivered alone or in combination with Sp182 RNP or ssODN OLI16431. All reagents were delivered via MaxCyte electroporation at 8 µM to 1×10⁶ CD34+ cells following 48 hours pre-stimulation in X-Vivo 10 media supplemented with SCF, TPO and FLT3. Following electroporation, cells were placed back to culture for a further 72 hours prior to indel quantification. Results indicate the "booster elements" Sp182 RNP or ssODN OLI16431 enhanced editing for all RNPs tested (FIG. 41).

The effect of editing using RNPs containing gRNAs with various 5' DNA extensions, or RNP without a 5' DNA extension (RNP45) co-delivered with or without ssODN OLI16431 was tested. Briefly, following 48 hours pre-stimulation in X-Vivo 10 media supplemented with SCF, TPO and FLT3, RNPs (RNP45 (no 5' modification), RNP46, RNP47, RNP48, RNP49, RNP50, RNP51, RNP52, RNP53, RNP54, RNP55, RNP56, and RNP57, Table 21) at a concentration of 8 µM were delivered alone or co-delivered with 8 µM ssODN OLI16431 via MaxCyte electroporation to 1×10⁶ CD34+ cells. Following electroporation, cells were placed back to culture prior to indel quantification. Results demonstrate that all RNPs support on-target editing (FIG. 42).

The effect of editing using RNPs including gRNAs having the same 5' DNA extension but different 3' gRNA modifications was tested to assess the impact of 3' gRNA modifications. Briefly, RNPs comprising gRNAs with matched 5' ends, but different 3' gRNA modifications (RNP49 vs. RNP58 and RNP59 v. RNP60) were delivered at a concentration of 8 µM via MaxCyte electroporation to 1×10⁶ CD34+ cells following 48 hours pre-stimulation in X-Vivo 10 media supplemented with SCF, TPO and FLT3. Following electroporation, cells were placed back to culture prior to indel quantification. In both comparisons, RNPs containing gRNA with 3' PS-OMe outperformed the unmodified 3' version at 24 h post electroporation (FIG. 43).

Next, different concentrations of Cpf1 and gRNA for RNP58 were tested. Briefly, RNP58 (+25 DNA 5' gRNA modification and 1×PS-OMe 3' gRNA modification, Table 21) was delivered via MaxCyte electroporation to 1×10⁶ CD34+ cells following 48 hours pre-stimulation at a stoichiometry (gRNA:Cpf1 complexation ratio) of either 2:1, 1:1 or 0.5:1 molar ratios. Following electroporation, cells were placed back to culture prior to indel quantification. At all doses tested, editing was best when RNP was complexed at a 2:1 ratio (FIGS. 44A-B).

The effect of editing using RNPs including gRNAs having the same 5' DNA extension but different 3' gRNA modifications was further tested to assess the impact of 3' gRNA modifications. Briefly, RNPs comprising gRNAs with matched 5' ends, but different 3' gRNA modifications (RNP58, RNP2, RNP3, RNP4, RNP5, RNP6, RNP7, RNP8, RNP9, RNP10) were delivered at varying concentrations (1 µM, 2 µM, 4 µM) via MaxCyte electroporation to 1×10⁶ CD34⁺ cells following 48 hours pre-stimulation. Following electroporation, cells were placed back to culture prior to indel quantification. Results indicate that all RNPs support on-target editing (FIGS. 45A-B).

Next, editing by RNPs that include gRNAs with 3' gRNA modifications or 5' and 3' modifications that target various regions of the HBG promoter were tested. Those include guide RNAs SEQ ID NOs:1085-1096, comprising targeting domains SEQ ID NOs:1260 (AsCpf1 HBG1 Promoter-1 (21mer)), 1262 (AsCpf1 HBG1 Promoter-2(21mer)), 1264 (AsCpf1 HBG1 Promoter-6 (21mer)) (Table 22, Table 23). Instead of the distal CCAAT box target region, those gRNAs are configured to provide an editing event within regions selected from Table 17. Briefly, RNPs including gRNAs containing an unmodified 5' gRNA and a 1×PS-OMe 3' gRNA modification (RNP11, RNP16, RNP19, and RNP22, Table 21), RNPs including gRNAs containing a +20 DNA+ 2×PS 5' gRNA modification and a 1×PS-OMe 3' gRNA modification (RNP12, RNP21, and RNP24, Table 21), RNPs including gRNAs containing a +25 DNA 5' gRNA modification and a 1×PS-OMe 3' gRNA modification (RNP58 and RNP20, Table 21) were delivered at a concentration of 8 µM via MaxCyte electroporation to 1×10⁶ CD34+ cells following 48 hours pre-stimulation in X-Vivo 10 media supplemented with SCF, TPO and FLT3. Following the editing of mPB CD34+ cells, ex vivo differentiation into the erythroid lineage was performed for 18 days (Giarratana 2011), with gDNA being isolated on day 14 of culture for indel analysis. Briefly, RNP was delivered to CD34+ cells, as described above. Following 48 hours recovery in X-Vivo 10 media supplemented with SCF, TPO and FLT3, the treated cells were counted and transferred to erythroid differentiation media, with cell counts and feeds occurring on days 4, 7, 10 and 14, with erythroid collection at day 18. These CD34⁺ derived erythroid cells were then counted and lysed in HPLC grade water, before filtering to removed cell debris. Then, relative expression levels of gamma-globin chains (over total beta-like globin chains) was measured for each sample by UPLC, with protein separation being achieved by gradually increasing the ratio of acetonitrile with 0.1% trifluoroacetic acid, to water with 0.1% trifluoroacetic acid (FIGS. 46A-C). FIGS. 46A-C showed all RNP supported on-target editing. However only editing at certain target sites give rise to increased HBF expression. The same experiment was performed with varying concentrations (0, 1 µM, 2 µM, 4 µM) of RNP58 (FIG. 47).

Next the effect of different Cpf1 proteins on RNP editing was tested. Briefly, RNP58, RNP26, RNP27, and RNP28 (Table 21) including gRNAs comprising SEQ ID NO:1051 (+25 DNA 5' gRNA modification and a 1×PS-OMe 3' gRNA modification, Table 19) complexed with varying Cpf1 proteins were delivered via MaxCyte electroporation at 8 µM to 1×10⁶ CD34+ cells following 48 hours pre-stimulation in X-Vivo 10 media supplemented with SCF, TPO and FLT3. Results demonstrated that all RNPs support on-target editing (FIG. 48).

Next the effect of different RNPs containing gRNAs with various 5' gRNA modifications and the same 3' modification was tested. Briefly, RNPs (RNP58 (+25 DNA 5' gRNA modification and a 1×PS-OMe 3' gRNA modification), RNP29 (+25 DNA+2×PS 5' gRNA modification and a 1×PS-OMe 3' gRNA modification), RNP30 (PolyA RNA+ 2×PS 5' gRNA modification and a 1×PS-OMe 3' gRNA modification), and RNP31 (PolyU RNA+2×PS 5' gRNA modification and a 1×PS-OMe 3' gRNA modification) (Table 21)) were delivered via MaxCyte electroporation at 1 µM, 2 µM, or 4 µM to 1×10⁶ CD34⁺ cells following 48 hours pre-stimulation in X-Vivo 10 media supplemented with SCF, TPO and FLT3 (RNP30 was not tested at 1 µM due to availability of cells). Results demonstrated that all RNPs support on-target editing (FIG. 49).

Next the effect of different Cpf1 proteins on RNP editing was tested. Briefly, RNP58, RNP27, and RNP26 (Table 21) including gRNAs comprising SEQ ID NO: 1051 (+25 DNA 5' gRNA modification and a 1×PS-OMe 3' gRNA modification, Table 19) complexed with varying Cpf1 proteins were delivered via MaxCyte electroporation at 2 µM or 4 µM to 1×10⁶ CD34+ cells following 48 hours pre-stimulation in X-Vivo 10 media supplemented with SCF, TPO and FLT3. To investigate the editing in bulk CD34, phenotypic progenitors, and phenotypic hematopoietic stem cells (HSCs), HSPC subpopulations were characterized. Thus, following electroporation, cells were placed back to culture for a further 48 hours prior to sorting into progenitor and HSC fractions for indel quantification. The level of insertions/deletions at the target site was analyzed by Illumina sequencing (NGS) of the PCR amplified target site at 48 hours after electroporation. Results demonstrated that all RNPs support on-target editing in bulk CD34, phenotypic progenitors, and phenotypic hematopoietic stem cells (FIG. 50).

Next, the effect of co-delivery of RNP with Sp182 RNP (dead gRNA comprising SEQ ID NO:1027 (Table 14) complexed with S. pyogenes Cas9 (SEQ ID NO:1033)) or ssODN OLI16431 (SEQ ID NO:1040, Table 11) on RNP containing different Cpf1 proteins was tested. Briefly, RNP61, RNP62, RNP34 (Table 21) were co-delivered at 8 µM with Sp182 RNP (8 µM) or ssODN OLI16431 (8 µM) to 25×10⁶ mPB CD34+ cells via MaxCyte electroporation, following 48 hours pre-stimulation in X-Vivo 10 media supplemented with SCF, TPO and FLT3. To investigate the editing in bulk CD34, phenotypic progenitors, and phenotypic hematopoietic stem cells (HSCs), HSPC subpopulations were characterized. Thus, following electroporation, cells were placed back to culture for a further 48 hours prior to sorting into progenitor and HSC fractions for indel quantification. The level of insertions/deletions at the target site was analyzed by Illumina sequencing (NGS) of the PCR amplified target site at 48 hours after electroporation. Results demonstrate that RNP co-delivered with the "booster elements" Sp182 RNP or ssODN OLI16431 support on-target editing (FIG. 51). A fraction of these cells were also cryopreserved 24 hours post electroporation to be further characterized in an in vivo engraftment model (see Example 23).

Next, the effect of RNP58 and RNP32 editing was tested. Briefly, RNP58 and RNP32 (Table 21) were delivered at 2 µM to 6×10⁶ mPB CD34+ cells via MaxCyte electroporation, following 48 hours pre-stimulation in X-Vivo 10 media supplemented with SCF, TPO and FLT3. To investigate the editing in bulk CD34, phenotypic progenitors, and phenotypic HSCs, HSPC subpopulations were characterized. Thus, following electroporation, cells were placed back to culture for a further 48 hours prior to sorting into progenitor and HSC fractions for indel quantification. The level of insertions/deletions at the target site was analyzed by Illumina sequencing (NGS) of the PCR amplified target site at 48 hours after electroporation. Results demonstrate that RNP58 and RNP32 support on-target editing (FIG. 52).

RNP58 and RNP1 (Table 21) were delivered at concentrations of 2 µM to 8 µM to 25×10⁶ mPB CD34+ cells via MaxCyte electroporation, following 48 hours pre-stimulation in X-Vivo 10 media supplemented with SCF, TPO and FLT3. To investigate the editing in bulk CD34, phenotypic progenitors, and phenotypic hematopoietic stem cells (HSCs), HSPC subpopulations were characterized. Thus, following electroporation, cells were placed back to culture for a further 48 hours prior to sorting into progenitor and HSC fractions for indel quantification. The level of insertions/deletions at the target site was analyzed by Illumina sequencing (NGS) of the PCR amplified target site at 48 hours after electroporation. Results demonstrate that the RNP tested support on-target editing (FIG. 53). A fraction of these cells were also cryopreserved 24 hours post electroporation for further characterized in an in vivo engraftment model (see Example 23).

Example 23: Infusion of Edited mPB CD34+ Cells into NOD, B6.SCID Il2rγ-/- Kit(W41/W41) Mice Results in Long Term Engraftment and HbF Induction To determine whether delivery of RNP34 and RNP33 (Table 21) co-delivered with ssODN OLI16431 (SEQ ID NO:1040, Table 11) achieves edits in long term repopulating hematopoietic stem cells, human adult CD34+ cells from mobilized peripheral blood (mPB) were infused into nonirradiated NOD, B6.SCID Il2rγ-/- Kit(W41/W41) (Jackson lab stock name: NOD.Cg-Kit<W-41J>Tyr<+>Prkdc<scid>Il2rg<tmlWjl>/ThomJ) ("NBSGW") mice. Briefly, mPB CD34+ cells at 62.5×10⁶/mL were electroporated via MaxCyte electroporation with RNP at a dose of 8 µM and 6 µM ssODN OLI16431 following 48 hours pre-stimulation in X-Vivo 10 media supplemented with SCF, TPO and FLT3. After 24 hours, mCD34+ cells were cryopreserved. Five days later, mPB CD34+ cells were thawed and infused into NBSGW mice at 1 million cells per mouse via intravenous tail vein injection. Eight weeks later, mice were euthanized and bone marrow (BM) was collected from femurs, tibias, and pelvic bones. Bone marrow sub-populations of cells respectively identified as CD15+, CD19+, glycophorin A (GlyA, CD235a+), and lineage-negative CD34+ were isolated by FACS, and DNA was extracted to determine the editing levels in each of these fractions. FIG. 54 depicts the frequency of indels, as determined by next generation sequencing, of unfractionated BM, or flow-sorted individual BM sub-populations.

Next, to determine whether delivery of RNP34 or RNP33 (Table 21) co-delivered with Sp182 RNP (dead gRNA comprising SEQ ID NO: 1027 (Table 14) complexed with S. pyogenes Cas9 (SEQ ID NO:1033)) achieves edits in long term repopulating hematopoietic stem cells, human adult CD34+ cells from mobilized peripheral blood (mPB) were infused into nonirradiated NBSGW mice. Briefly, mPB CD34+ cells at 62.5×10⁶/mL were electroporated via MaxCyte electroporation with RNP at varying doses and varying doses of Sp182 RNP following 48 hours pre-stimulation in X-Vivo 10 media supplemented with SCF, TPO and FLT3. After 24 hours, mCD34+ cells were cryopreserved. Five days later, mPB CD34+ cells were thawed and infused into NBSGW mice at 1 million cells per mouse via intravenous tail vein injection. Eight weeks later, mice were euthanized and bone marrow (BM) was collected from femurs, tibias, and pelvic bones. Bone marrow sub-populations of cells respectively identified as CD15+, CD19+, glycophorin A (GlyA, CD235a+), and lineage-negative CD34+ were isolated by FACS, and DNA was extracted to determine the editing levels in each of these fractions. FIG. 55A depicts the frequency of indels, as determined by next generation sequencing, of unfractionated BM, or flow-sorted individual BM sub-populations.

Lastly, long term HbF induction by BM-derived CD34+ cells was analyzed. An aliquot of BM cells were cultured under erythroid differentiation conditions for 18 days (Giarratana 2011), and evaluated for HbF expression by UPLC. Briefly, unfractionated BM cells extracted from mice 8 weeks after infusion were placed in erythroid culture conditions for 18 days. Cell counts and feeds occurred on days 7, 10 and 14, with erythroid collection at day 18. These bone marrow derived erythroid cells were then counted and lysed in HPLC grade water before filtering to removed cell debris. Then, relative expression levels of gamma-globin chains (over total beta-like globin chains) was measured for each sample by UPLC, with protein separation being achieved by gradually increasing the ratio of acetonitrile with 0.1% trifluoroacetic acid, to water with 0.1% trifluoroacetic acid (FIG. 54B). These data demonstrate that robust long-term HbF induction is achieved by RNP34 and RNP33 co-delivered with Sp182 RNP editing of human CD34+ cells.

Next, to determine whether delivery of RNP61 or RNP62 (Table 21) co-delivered with ssODN OLI16431 (SEQ ID NO:1040, Table 11) achieves edits in long term repopulating hematopoietic stem cells, human adult CD34+ cells from mPB were infused into nonirradiated NBSGW mice. Briefly, mPB CD34+ cells at 62.5×10⁶/mL were electroporated via MaxCyte electroporation with 8 µM RNP and 8 µM ssODN OLI16431 following 48 hours pre-stimulation in X-Vivo 10 media supplemented with SCF, TPO and FLT3. After 24 hours, mCD34+ cells were cryopreserved. Four days later, mPB CD34+ cells were thawed and infused into NBSGW mice at 1 million cells per mouse via intravenous tail vein injection. Eight weeks later, mice were euthanized and bone marrow (BM) was collected from femurs, tibias, and pelvic bones. Bone marrow sub-populations of cells respectively identified as CD15+, CD19+, glycophorin A (GlyA, CD235a+), and lineage-negative CD34+ were isolated by FACS, and DNA was extracted to determine the editing levels in each of these fractions. FIG. 56A depicts the frequency of indels, as determined by next generation sequencing, of unfractionated BM, or flow-sorted individual BM sub-populations.

Lastly, long term HbF induction by BM-derived CD235a+ (GlyA+) erythroid cells was analyzed. An aliquot of BM cells were cultured under erythroid differentiation conditions for 18 days and evaluated for HbF expression by UPLC. Briefly, unfractionated BM cells extracted from mice 8 weeks after infusion were placed in erythroid culture conditions for 18 days. FIG. 56B depicts the HbF expression, calculated as gamma/beta-like chains (%) by erythroid cells. These data demonstrate that robust long-term HbF induction is achieved by RNP61 and RNP62 co-delivered with ssODN OLI16431 editing of human CD34+ cells.

Next, to determine whether delivery of RNP1 or RNP58 (Table 21) achieves edits in long term repopulating hematopoietic stem cells, human adult CD34+ cells from mPB were infused into nonirradiated NBSGW mice. Briefly, mPB CD34+ cells at 62.5×10$^6$/mL were electroporated via MaxCyte electroporation with 4 µM or 8 µM RNP1 or 2 µM, 4 µM, or 8 µM RNP58 following 48 hours pre-stimulation in X-Vivo 10 media supplemented with SCF, TPO and FLT3. After 24 hours, mCD34+ cells were cryopreserved. Four days later, mPB CD34+ cells were thawed and infused into NBSGW mice at 1 million cells per mouse via intravenous tail vein injection. Eight weeks later, mice were euthanized and bone marrow (BM) was collected from femurs, tibias, and pelvic bones. Human chimerism and lineage reconstitution (CD45+, CD14+, CD19+, glycophorin A (GlyA, CD235a+), lineage, and CD34+, and mouse CD45+ marker expression) in BM was determined by flow cytometry and analyzed (FIG. 57). The frequency of GlyA+ cells was calculated as GlyA+ cells/total cells in BM. Human chimerism was defined as human CD45/(human CD45+mCD45).

Similar chimerism and lineage distributions were achieved 8-weeks post-transplant by RNP-transfected mPB CD34+ cells compared to mock-transfected mPB CD34+ cells demonstrating that editing is comparable with retaining the engraftment potential of hematopoietic stem cells. FIG. 58 depicts the indels, as determined by next generation sequencing, of unfractionated BM, at 8 weeks post-infusion. FIG. 59 shows the frequency of indel rate in BM, CD15+, CD19+, glycophorin A (GlyA, CD235a+), and lin-CD34+ cells with 2 µM, 4 µM, or 8 µM of RNP58.

Long term HbF induction by CD235a+(GlyA+) erythroid cells, derived from edited CD34+ cells was also analyzed. GlyA+ cells obtained from bone marrow, were isolated by fluorescence Activated Cell Sorting (FACS), collected and lysed in HPLC grade water. Lysates were then evaluated for HbF expression by UPLC. FIG. 60 depicts the HbF expression, calculated as gamma/beta-like chains (%) by GlyA+ cells. These data demonstrate that robust long-term HbF induction is achieved RNP58 editing of human CD34+ cells at various RNP58 concentrations.

Importantly, CD34$^+$ cells that were electroporated with varying concentrations of RNP1 or RNP58 maintained their ex vivo hematopoietic activity (i.e., no difference in the quantity or diversity of erythroid and myeloid colonies compared to untreated donor matched CD34$^+$ cell negative control), as determined in hematopoietic colony forming cell (CFC) assays (FIG. 61).

Example 24: Treatment of β-Hemoglobinopathy Using Edited Hematopoietic Stem Cells The methods and genome editing systems disclosed herein may be used for the treatment of a β-hemoglobinopathy, such as sickle cell disease or beta-thalassemia, in a patient in need thereof. For example, genome editing may be performed on cells derived from the patient in an autologous procedure. Correction of the patient's cells ex-vivo and reintroduction of the cells into the patient may result in increased HbF expression and treatment of the β-hemoglobinopathy.

For example, HSCs may be extracted from the bone marrow of a patient with a β-hemoglobinopathy using techniques that are well-known to skilled artisans. The HSCs may be modified using methods disclosed herein for genome editing. For example, RNPs comprised of guide RNAs (gRNA) that target one or more regions in the HBG gene complexed with an RNA-guided nuclease may be used to edit the HSCs. In certain embodiments, the RNA-guided nuclease may be a Cpf1 protein. In certain embodiments, the Cpf1 protein may be a modified Cpf1 protein. In certain embodiments, the modified Cpf1 protein may be encoded by a sequence set forth in SEQ ID NOs:1000, 1001, 1008-1018, 1032, 1035-39, 1094-1097, 1107-09 (Cpf1 polypeptide sequences) or SEQ ID NOs:1019-1021, 1110-17 (Cpf1 polynucleotide sequences). For example, the modified Cpf1 protein may be encoded by the sequence set forth in SEQ ID NO:1097. In certain embodiments, the gRNA may be a modified or unmodified gRNA. In certain embodiments, the gRNA may comprise a sequence set forth in Table 13, Table 18, or Table 19. For example, in certain embodiments, the gRNA may comprise the sequence set forth in SEQ ID NO:1051. In certain embodiments, the RNP complex may comprise an RNP complex set forth in Table 21. For example, the RNP complex may include a gRNA comprising the sequence set forth in SEQ ID NO:1051 and a modified Cpf1 protein encoded by the sequence set forth in SEQ ID NO:1097 (RNP32, Table 21). In certain embodiments, modified HSCs have an increase in the frequency or level of an indel in the human HBG1 gene, HBG2 gene, or both, relative to unmodified HSCs. In certain embodiments, the modified HSCs can differentiate into erythroid cells that express an increased level of HbF. A population of the modified HSCs may be selected for reintroduction into the patient via transfusion or other methods known to skilled artisans. The population of modified HSCs for reintroduction may be selected based on, for example, increased HbF expression of the erythroid progeny of the modified HSCs or increased indel frequency of the modified HSCs. In some embodiments, any form of ablation prior to reintroduction of the cells may be used to enhance engraftment of the modified HSCs. In other embodiments, peripheral blood stem cells (PBSCs) can be extracted from a patient with a β-hemoglobinopathy using techniques that are well-known to skilled artisans (e.g., apheresis or leukapheresis) and stem cells can be removed from the PBSCs. The genome editing methods described above can be performed on the stem cells and the modified stem cells can be reintroduced into the patient as described above.

TABLE 20

| Cpf1 Protein Variants | | |
| --- | --- | --- |
| Cpf1 Variant ID | Cpf1 Variant Amino Acid SEQ ID NO | Cpf1 Variant Nucleotide SEQ ID NO |
| His-AsCpf1-sNLS-SNLS H800A | SEQ ID NO: 1032 | SEQ ID NO: 1110 |
| Cpf1-1 | SEQ ID NO: 1094 | SEQ ID NO: 1111 |
| Cpf1-2 | SEQ ID NO: 1095 | SEQ ID NO: 1112 |
| Cpf1-3 | SEQ ID NO: 1096 | SEQ ID NO: 1113 |
| Cpf1-4 | SEQ ID NO: 1097 | SEQ ID NO: 1114 |
| Cpf1-5 | SEQ ID NO: 1107 | SEQ ID NO: 1115 |
| Cpf1-6 | SEQ ID NO: 1108 | SEQ ID NO: 1116 |
| Cpf1-7 | SEQ ID NO: 1109 | SEQ ID NO: 1117 |

TABLE 21

| RNP Name | gRNA SEQ ID NO* | Cpf1 Amino Acid SEQ ID NO** |
|---|---|---|
| RNP64 | SEQ ID NO: 1022 | SEQ ID NO: 1109 |
| RNP1 | SEQ ID NO: 1051 | SEQ ID NO: 1095 |
| RNP2 | SEQ ID NO: 1098 | SEQ ID NO: 1094 |
| RNP3 | SEQ ID NO: 1099 | SEQ ID NO: 1094 |
| RNP4 | SEQ ID NO: 1100 | SEQ ID NO: 1094 |
| RNP5 | SEQ ID NO: 1101 | SEQ ID NO: 1094 |
| RNP6 | SEQ ID NO: 1068 | SEQ ID NO: 1094 |
| RNP7 | SEQ ID NO: 1102 | SEQ ID NO: 1094 |
| RNP8 | SEQ ID NO: 1081 | SEQ ID NO: 1094 |
| RNP9 | SEQ ID NO: 1082 | SEQ ID NO: 1094 |
| RNP10 | SEQ ID NO: 1083 | SEQ ID NO: 1094 |
| RNP11 | SEQ ID NO: 1069 | SEQ ID NO: 1094 |
| RNP12 | SEQ ID NO: 1084 | SEQ ID NO: 1094 |
| RNP16 | SEQ ID NO: 1085 | SEQ ID NO: 1094 |
| RNP19 | SEQ ID NO: 1088 | SEQ ID NO: 1094 |
| RNP20 | SEQ ID NO: 1089 | SEQ ID NO: 1094 |
| RNP21 | SEQ ID NO: 1090 | SEQ ID NO: 1094 |
| RNP22 | SEQ ID NO: 1091 | SEQ ID NO: 1094 |
| RNP23 | SEQ ID NO: 1048 | SEQ ID NO: 1097 |
| RNP24 | SEQ ID NO: 1093 | SEQ ID NO: 1094 |
| RNP26 | SEQ ID NO: 1051 | SEQ ID NO: 1096 |
| RNP27 | SEQ ID NO: 1051 | SEQ ID NO: 1107 |
| RNP28 | SEQ ID NO: 1051 | SEQ ID NO: 1108 |
| RNP29 | SEQ ID NO: 1103 | SEQ ID NO: 1094 |
| RNP30 | SEQ ID NO: 1104 | SEQ ID NO: 1094 |
| RNP31 | SEQ ID NO: 1105 | SEQ ID NO: 1094 |
| RNP32 | SEQ ID NO: 1051 | SEQ ID NO: 1097 |
| RNP33 | SEQ ID NO: 1022 | SEQ ID NO: 1032 |
| RNP34 | SEQ ID NO: 1041 | SEQ ID NO: 1032 |
| RNP37 | SEQ ID NO: 1042 | SEQ ID NO: 1032 |
| RNP38 | SEQ ID NO: 1043 | SEQ ID NO: 1032 |
| RNP39 | SEQ ID NO: 1044 | SEQ ID NO: 1032 |
| RNP40 | SEQ ID NO: 1045 | SEQ ID NO: 1032 |
| RNP41 | SEQ ID NO: 1046 | SEQ ID NO: 1032 |
| RNP42 | SEQ ID NO: 1047 | SEQ ID NO: 1032 |
| RNP43 | SEQ ID NO: 1048 | SEQ ID NO: 1032 |
| RNP44 | SEQ ID NO: 1049 | SEQ ID NO: 1032 |
| RNP45 | SEQ ID NO: 1022 | SEQ ID NO: 1094 |
| RNP46 | SEQ ID NO: 1046 | SEQ ID NO: 1094 |
| RNP47 | SEQ ID NO: 1047 | SEQ ID NO: 1094 |
| RNP48 | SEQ ID NO: 1052 | SEQ ID NO: 1094 |
| RNP49 | SEQ ID NO: 1048 | SEQ ID NO: 1094 |
| RNP50 | SEQ ID NO: 1053 | SEQ ID NO: 1094 |
| RNP51 | SEQ ID NO: 1054 | SEQ ID NO: 1094 |
| RNP52 | SEQ ID NO: 1055 | SEQ ID NO: 1094 |
| RNP53 | SEQ ID NO: 1056 | SEQ ID NO: 1094 |
| RNP54 | SEQ ID NO: 1057 | SEQ ID NO: 1094 |
| RNP55 | SEQ ID NO: 1058 | SEQ ID NO: 1094 |
| RNP56 | SEQ ID NO: 1059 | SEQ ID NO: 1094 |
| RNP57 | SEQ ID NO: 1060 | SEQ ID NO: 1094 |
| RNP58 | SEQ ID NO: 1051 | SEQ ID NO: 1094 |
| RNP59 | SEQ ID NO: 1067 | SEQ ID NO: 1094 |
| RNP60 | SEQ ID NO: 1068 | SEQ ID NO: 1094 |
| RNP61 | SEQ ID NO: 1041 | SEQ ID NO: 1095 |
| RNP62 | SEQ ID NO: 1041 | SEQ ID NO: 1094 |
| RNP63 | SEQ ID NO: 1022 | SEQ ID NO: 1095 |

*See Table 19
**See Table 20

TABLE 22

Cpf1 HBG1 targeting domains and expected cleavage sites

| gRNA ID | gRNA Targeting Domain (RNA) | gRNA Targeting Domain (DNA) | Targeting Domain coordinates at HBG1 * | Expected cleavage site coordinates at HBG1# | Strand | Targeting Domain Length |
|---|---|---|---|---|---|---|
| HBG1-1 | CCUUGUCAAGGCUAUUGUC (SEQ ID NO: 1002) | CCTTGTCAAGGCTATTGGTC (SEQ ID NO: 1003) | Chr11:5249954-5249974 | Chr11:5249973, Chr11:5249977 | + | 20 |
| HBG1-1 (21mer) | CCUUGUCAAGGCUAUUGUCA (SEQ ID NO: 1254) | CCTTGTCAAGGCTATTGGTCA (SEQ ID NO: 1255) | Chr11:5249954-5249975 | Chr11:5249973, Chr11:5249977 | + | 21 |
| HBG1-1 (22mer) | CCUUGUCAAGGCUAUUGUCAA (SEQ ID NO: 1256) | CCTTGTCAAGGCTATTGGTCAA (SEQ ID NO: 1257) | Chr11:5249954-5249976 | Chr11:5249973, Chr11:5249977 | + | 22 |
| HBG1-1 (23mer) | CCUUGUCAAGGCUAUUGUCAAG (SEQ ID NO: 1258) | CCTTGTCAAGGCTATTGGTCAAG (SEQ ID NO: 1259) | Chr11:5249954-5249976 | Chr11:5249973, Chr11:5249977 | + | 23 |
| AsCpf1 HBG1 Promoter-1 | AGACAGAUAUUUGCAUUGAG (SEQ ID NO: 1139) | AGACAGATATTTGCATTGAG (SEQ ID NO: 1140) | Chr11:5250023-5250043 | Chr11:5250042, Chr11:5250046 | + | 20 |
| AsCpf1 HBG1 Promoter-1 (21mer) | AGACAGAUAUUUGCAUUGAGA (SEQ ID NO: 1260) | AGACAGATATTTGCATTGAGA (SEQ ID NO: 1261) | Chr11:5250023-5250044 | Chr11:5250042, Chr11:5250046 | + | 21 |

TABLE 22-continued

Cpf1 HBG1 targeting domains and expected cleavage sites

| gRNA ID | gRNA Targeting Domain (RNA) | gRNA Targeting Domain (DNA) | Targeting Domain coordinates at HBG1 * | Expected cleavage site coordinates at HBG1# | Strand | Targeting Domain Length |
|---|---|---|---|---|---|---|
| AsCpf1 HBG1 Promoter-2 | CAUUGAGA UAGUGUGG GGAA (SEQ ID NO: 1141) | CATTGAGA TAGTGTGG GGAA (SEQ ID NO: 1142) | Chr11:5250036-Chr11:5250056 | Chr11:5250055, Chr11:5250059 | + | 20 |
| AsCpf1 HBG1 Promoter-2 (21mer) | CAUUGAGA UAGUGUGG GGAAG (SEQ ID NO: 1262) | CATTGAGA TAGTGTGG GGAAG (SEQ ID NO: 1263) | Chr11:5250036-Chr11:5250057 | Chr11:5250055, Chr11:5250059 | + | 21 |
| AsCpf1 HBG1 Promoter-6 | CUUCUCCCA UCAUAGAG GAU (SEQ ID NO: 1149) | CTTCTCCCA TCATAGAG GAT (SEQ ID NO: 1150) | Chr11:5250160-Chr11:5250180 | Chr11:5250179, Chr11:5250183 | + | 20 |
| AsCpf1 HBG1 Promoter-6 (21 mer) | CUUCUCCCA UCAUAGAG GAUA (SEQ ID NO: 1264) | CTTCTCCCA TCATAGAG GATA (SEQ ID NO: 1265) | Chr11:5250160-Chr11:5250181 | Chr11:5250179, Chr11:5250183 | + | 21 |

* NCBI Reference Sequence NC_000011, the coordinates are reported using the One-based coordinate system, "Homo sapiens chromosome 11, GRCh38.p12 Primary Assembly," (Version NC_000011.10).
Expected cleavage sites based on Zetsche et al, 2015, coordinates are reported using zero-based coordinates.

TABLE 23

Cpf1 HBG2 targeting domains and expected cleavage sites

| gRNA ID | gRNA Targeting Domain (RNA) | gRNA Targeting Domain (DNA) | Targeting Domain coordinates at HBG2 * | Expected cleavage site coordinates at HBG2# | Strand | Targeting Domain Length |
|---|---|---|---|---|---|---|
| HBG1-1 | CCUUGUCAA GGCUAUUG GUC (SEQ ID NO: 1002) | CCTTGTCAAG GCTATTGGTC (SEQ ID NO: 1003) | Chr11:5254878 Chr11:5254898 | Chr11:5254897, Chr11:5254901 | + | 20 |
| HBG1-1 21mer | CCUUGUCAA GGCUAUUG GUCA (SEQ ID NO: 1254) | CCTTGTCAAG GCTATTGGTC A (SEQ ID NO: 1255) | Chr11:5254878 Chr11:5254899 | Chr11:5254897, Chr11:5254901 | + | 21 |
| HBG1-1 22mer | CCUUGUCAA GGCUAUUG GUCAA (SEQ ID NO: 1256) | CCTTGTCAAG GCTATTGGTC AA (SEQ ID NO: 1257) | Chr11:5254878 Chr11:5254900 | Chr11:5254897, Chr11:5254901 | + | 22 |
| HBG1-1 23mer | CCUUGUCAA GGCUAUUG GUCAAG (SEQ ID NO: 1258) | CCTTGTCAAG GCTATTGGTC AAG (SEQ ID NO: 1259) | Chr11:5254878 Chr11:5254901 | Chr11:5254897, Chr11:5254901 | + | 23 |
| AsCpf1 HBG1 Promoter-1 | AGACAGAU AUUUGCAU UGAG (SEQ ID NO: 1139) | AGACAGATA TTTGCATTGA G (SEQ ID NO: 1140) | Chr11:5254947 Chr11:5254967 | Chr11:5254966 Chr11:5254970 | + | 20 |
| AsCpf1 HBG1 Promoter-1 (21mer) | AGACAGAU AUUUGCAU UGAGA (SEQ ID NO: 1260) | AGACAGATA TTTGCATTGA GA (SEQ ID NO: 1261) | Chr11:5254947 Chr11:5254968 | Chr11:5254966 Chr11:5254970 | + | 21 |

TABLE 23-continued

Cpf1 HBG2 targeting domains and expected cleavage sites

| gRNA ID | gRNA Targeting Domain (RNA) | gRNA Targeting Domain (DNA) | Targeting Domain coordinates at HBG2 * | Expected cleavage site coordinates at HBG2# | Strand | Targeting Domain Length |
|---|---|---|---|---|---|---|
| AsCpf1 HBG1 Promoter-2 | CAUUGAGA UAGUGUGG GGAA (SEQ ID NO: 1141) | CATTGAGAT AGTGTGGGG AA (SEQ ID NO: 1142) | Chr11:5254960 Chr11:5254980 | Chr11:5254979 Chr11:5254983 | + | 20 |
| AsCpf1 HBG1 Promoter-2 (21mer) | CAUUGAGA UAGUGUGG GGAAG (SEQ ID NO: 1262) | CATTGAGAT AGTGTGGGG AAG (SEQ ID NO: 1263) | Chr11:5254960 Chr11:5254981 | Chr11:5254979 Chr11:5254983 | + | 21 |

* NCBI Reference Sequence NC_000011, the coordinates are reported using the One-based coordinate system, "Homo sapiens chromosome 11, GRCh38.p12 Primary Assembly," (Version NC_000011.10).
Expected cleavage sites based on (Zetsche et al, 2015), coordinates are reported using zero-based coordinates.

TABLE 24 gRNA 5' Extensions

| 5' extension Sequence ID No: | 5' extension sequence | 5' modification |
|---|---|---|
| 1231 | rCrUrUrUrU | +5 RNA |
| 1232 | rArArGrArCrUrUrUrU | +10 RNA |
| 1233 | rArUrGrUrGrUrUrUrUrUrGrUrCrArArArArGrArCrUrUrUrU | +25 RNA |
| 1234 | rArGrGrCrCrArGrCrUrUrGrCrCrGrGrUrUrUrUrUrArGrUrCrG rUrGrCrUrGrCrUrUrCrArUrGrUrGrUrUrUrUrUrGrUrCrArArAr ArGrArCrUrUrUrU | +60 RNA |
| 1235 | CTTTT | +5 DNA |
| 1236 | AAGACCTTTT | +10 DNA |
| 1237 | ATGTGTTTTTGTCAAAAGACCTTTT | +25 DNA |
| 1238 | AGGCCAGCTTGCCGGTTTTTAGTCGTGCTGCTTCATGTG TTTTTGTCAAAAGACCTTTT | +60 DNA |
| 1239 | TTTTTGTCAAAAGACCTTTT | +20 DNA |
| 1240 | GCTTCATGTGTTTTTGTCAAAAGACCTTTT | +30 DNA |
| 1241 | GCCGGTTTTTAGTCGTGCTGCTTCATGTGTTTTTGTCAAA AGACCTTTT | +50 DNA |
| 1242 | TAGTCGTGCTGCTTCATGTGTTTTTGTCAAAAGACCTTIT | +40 DNA |
| 1243 | C*C*GAAGTTTTCTTCGGTTTT | +20 DNA + 2xPS |
| 1244 | T*T*TTTCCGAAGTTTTCTTCGGTTTT | +25 DNA + 2xPS |
| 1245 | A*A*CGCTTTTTCCGAAGTTTTCTTCGGTTTT | +30 DNA + 2xPS |
| 1246 | G*C*GTTGTTTTCAACGCTTTTTCCGAAGTTTTCTTCGGTT TT | +41 DNA + 2xPS |
| 1247 | G*G*CTTCTTTTGAAGCCTTTTTGCGTTGTTTTCAACGCTT TTTCCGAAGTTTTCTTCGGTTTT | +62 DNA + 2xPS |
| 1248 | A*T*GTGTTTTTGTCAAAAGACCTTTT | +25 DNA + 2xPS |
| 1249 | AAAAAAAAAAAAAAAAAAAAAAAAA | +25 A |

TABLE 24-continued gRNA 5' Extensions

| 5' extension Sequence ID No: | 5' extension sequence | 5' modification |
|---|---|---|
| 1250 | TTTTTTTTTTTTTTTTTTTTTTTTT | +25 T |
| 1251 | mA*mU*rGrUrGrUrUrUrUrGrUrCrArArArGrArCrCrUrUrU rU | +25 RNA + 2xPS |
| 1252 | mA*mA*rArArArArArArArArArArArArArArArArArArArAr ArA | PolyA RNA + 2xPS |
| 1253 | mU*mU*rUrUrUrUrUrUrUrUrUrUrUrUrUrUrUrUrUrUrUr UrU | PolyU RNA + 2xPS |

All bases are in upper case
Lowercase "r" represents RNA, 2'-hydroxy; bases not modified by an "r" are DNA
All bases are linked via standard phosphodiester bonds except as noted:
"*" represents phosphorothioate modification
"PS" represents phosphorothioate modification

TABLE 19

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1022 | rUrArArUrUrUrCrUrArCrUrCrUrUrGrUrArGrArUrCrCrUrUrGr UrCrArArGrGrCrUrArUrUrGrGrUrC | - | - | 40 | 20 | CCUUGUCAA GGCUAUUGG UC (SEQ ID NO: 1002) |
| 1023 | rUrArArUrUrUrCrUrArCrUrCrUrUrGrUrArGrArUrCrCrUrUrGr UrCrArArGrGrCrUrArUrUrGrGrUmC/PS2/mA | - | 1xPS2-OMe + 1xOMe | 41 | 21 | CCUUGUCAA GGCUAUUGG UCA (SEQ ID NO: 1254) |
| 1041 | rUrArArUrUrUrCrUrArCrUrCrUrUrGrUrArGrArUrCrCrUrUrGr UrCrArArGrGrCrUrArUrUrGrGmU/PS2/mC | - | 1xPS2-OMe + 1xOMe | 40 | 20 | CCUUGUCAA GGCUAUUGG UC (SEQ ID NO: 1002) |
| 1042 | rCrUrUrUrUrArArUrUrCrUrArCrArCrUrUrGrUrArGrArUrCrCrUrUrGrUrCrArArGrGrCrUrArUrUrGrGrUrC | +5 RNA | - | 45 | 20 | CCUUGUCAA GGCUAUUGG UC (SEQ ID NO: 1002) |
| 1043 | rArArGrArCrCrUrUrUrUrArArUrUrUrCrUrArCrUrCrUrUrGrUrArGrArUrCrCrUrUrGrUrCrArArGrGrCrUrArUrUrGrGrUrC | +10 RNA | - | 50 | 20 | CCUUGUCAA GGCUAUUGG UC (SEQ ID NO: 1002) |
| 1044 | rArUrGrGrUrUrUrUrUrGrUrCrArArArArGrArCrCrUrUrUrUrUrArArUrUrUrCrUrArCrUrCrUrUrGrUrArGrArUrCrCrUrUrGrUrCrArArGrGrCrUrArUrUrGrGrUrC | +25 RNA | - | 65 | 20 | CCUUGUCAA GGCUAUUGG UC (SEQ ID NO: 1002) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1045 | rArGrCrCrArGrCrUrUrGrCrCrGrGrUrUrUrUrUrUrArGrUrCrGrUrGrCrUrGrCrUrUrCrArUrGrUrGrUrUrUrUrUrGrUrCrArArArArGrArCrCrUrUrUrUrUrArArUrUrUrCrUrArCrUrCrUrUrGrUrArGrArUrCrUrUrGrrUrCrArArGrGrCrUrArUrUrGrGrUrC | +60 RNA | - | 100 | 20 | CCUUGUCAA GGCUAUUGG UC (SEQ ID NO: 1002) |
| 1046 | CTTTTrUrArArUrUrUrCrUrArCrUrCrUrUrrGrUrArGrArUrCrCrUrUrGrUrCrArArGrrCrUrArUrGrGrUrC | +5 DNA | - | 45 | 20 | CCUUGUCAA GGCUAUUGG UC (SEQ ID NO: 1002) |
| 1047 | AAGACCTTTTrUrArArUrUrUrCrUrArCrUrCrUrUrGrUrArGrArUrCrCrUrUrGrUrCrArArGrGrCrUrArUrUrGrGrUrC | +10 DNA | - | 50 | 20 | CCUUGUCAA GGCUAUUGG UC (SEQ ID NO: 1002) |
| 1048 | ATGTGTTTTGTCA AAAGACCTTTTrUrArArUrUrUrCrUrArCrUrCrUrUrGrUrArGrArUrCrCrUrUrGrUrCrArArGrGrCrUrArUrUrGrGrUrC | +25 DNA | - | 65 | 20 | CCUUGUCAA GGCUAUUGG UC (SEQ ID NO: 1002) |
| 1049 | AGGCCAGCTTGCC GGTTTTTTAGTCGT GCTGCTTCATGTG TTTTTGTCAAAAG ACCTTTTrUrArArUrUrUrCrUrArCrUrCrUrUrGrUrArGrArUrCrCrUrUrGrUrCrArArGrGrCrUrArUrUrGrGrUrC | +60 DNA | - | 100 | 20 | CCUUGUCAA GGCUAUUGG UC (SEQ ID NO: 1002) |
| 1050 | ATGTGTTTTGTCA AAAGACCTTTTrUrArArUrUrUrCrUrArCrUrCrUrUrGrUrArGrArUrCrCrUrUrGrUrCrArArGrGrCrUrArUrUrGrGrUrUmC/PS2/mA | +25 DNA | 1xPS2-OMe + 1xOMe | 66 | 21 | CCUUGUCAA GGCUAUUGG UCA (SEQ ID NO: 1254) |
| 1051 | ATGTGTTTTGTCA AAAGACCTTTTrUrArArUrUrUrCrUrArCrUrCrUrUrGrUrArGrArUrCrCrUrUrGrUrCrArArGrGrCrUrArUrUrGrGrUrC*mA | +25 DNA | 1xPS-OMe | 66 | 21 | CCUUGUCAA GGCUAUUGG UCA (SEQ ID NO: 1254) |
| 1052 | TTTTTGTCAAAAG ACCTTTTrUrArArUrUrUrCrUrArCrUrCrUrUrGrUrArGrArUrCrCrUrUrGrUrCrArArGrGrCrUrArUrUrGrGrUrC | +20 DNA | - | 60 | 20 | CCUUGUCAA GGCUAUUGG UC (SEQ ID NO: 1002) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1053 | GCTTCATGTGTTTT TGTCAAAAGACCT TTTrUrArArUrUrC rUrArCrUrCrUrGr UrArGrArUrCrCrU rGrUrCrArArGrGrC UrArUrGrGrUrC | +30 DNA | - | 70 | 20 | CCUUGUCAA GGCUAUUGG UC (SEQ ID NO: 1002) |
| 1054 | GCCGGTTTTTTAG TCGTGCTGCTTCA TGTGTTTTTGTCAA AAGACCTTTTrUrAr ArUrUrCrUrArCrU rCrUrUrGrUrArGrAr UrCrCrUrGrUrCrA rArGrGrCrUrArUrUr GrGrUrC | +50 DNA | - | 90 | 20 | CCUUGUCAA GGCUAUUGG UC (SEQ ID NO: 1002) |
| 1055 | TAGTCGTGCTGCT TCATGTGTTTTTGT CAAAAGACCTTTTr UrArArUrUrCrUrA rCrUrCrUrUrGrUrAr GrArUrCrCrUrUrGrU rCrArArGrGrCrUrAr UrUrGrGrUrC | +40 DNA | - | 80 | 20 | CCUUGUCAA GGCUAUUGG UC (SEQ ID NO: 1002) |
| 1056 | C*C*GAAGTTTTCT TCGGTTTTrUrArAr UrUrCrUrArCrUrC rUrUrGrUrArGrArUr CrCrUrGrUrCrArA rGrGrCrUrArUrUrGr GrUrC | +20 DNA + 2xPS | - | 60 | 20 | CCUUGUCAA GGCUAUUGG UC (SEQ ID NO: 1002) |
| 1057 | T*T*TTTCCGAAGT TTTCTTCGGTTTTr UrArArUrUrCrUrA rCrUrCrUrUrGrUrAr GrArUrCrCrUrUrGrU rCrArArGrGrCrUrAr UrUrGrGrUrC | +25 DNA + 2xPS | - | 65 | 20 | CCUUGUCAA GGCUAUUGG UC (SEQ ID NO: 1002) |
| 1058 | A*A*CGCTTTTTCC GAAGTTTTCTTCG GTTTTrUrArArUrUr UrCrUrArCrUrCrUrU rGrUrArGrArUrCrCr UrUrGrUrCrArArGrG rCrUrArUrUrGrGrUr C | +30 DNA + 2xPS | - | 70 | 20 | CCUUGUCAA GGCUAUUGG UC (SEQ ID NO: 1002) |
| 1059 | G*C*GTTGTTTTCA ACGCTTTTTCCGA AGTTTTCTTCGGTT TTrUrArArUrUrUrCr UrArCrUrCrUrUrGrU rArGrArUrCrCrUrUr GrUrCrArArGrGrCrU rArUrUrGrGrUrC | +41 DNA + 2xPS | - | 81 | 20 | CCUUGUCAA GGCUAUUGG UC (SEQ ID NO: 1002) |
| 1060 | G*G*CTTCTTTTGA AGCCTTTTGCGTT GTTTTCAACGCTTT TTCCGAAGTTTTCT TCGGTTTTrUrArAr rUrUrCrUrArCrUrC rUrUrGrUrArGrArUr CrCrUrGrUrCrArA rGrGrCrUrArUrUrGr GrUrC | +62 DNA + 2xPS | - | 102 | 20 | CCUUGUCAA GGCUAUUGG UC (SEQ ID NO: 1002) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1061 | mUrArArUrUrUrCrUrArCrUrCrUrUrGrUrArGrArUrCrUrCrUrUrGrUrCrArArGrGrCrUrArUrUrGrGrUrC | 1xOMe | - | 40 | 20 | CCUUGUCAAGGCUAUUGGUC (SEQ ID NO: 1002) |
| 1062 | mU*rArArUrUrUrCrUrArCrUrCrUrUrGrUrArGrArUrCrUrCrUrUrGrUrCrArArGrGrCrUrArUrUrGrGrUrC | 1xPS-OMe | - | 40 | 20 | CCUUGUCAAGGCUAUUGGUC (SEQ ID NO: 1002) |
| 1063 | mUmArArUrUrUrCrUrArCrUrCrUrUrGrUrArGrArUrCrUrCrUrUrGrUrCrArArGrGrCrUrArUrUrGrGrUrC | 2xOMe | - | 40 | 20 | CCUUGUCAAGGCUAUUGGUC (SEQ ID NO: 1002) |
| 1064 | mU*mA*rArUrUrUrCrUrArCrUrCrUrUrGrUrArGrArUrCrUrCrUrUrGrUrCrArArGrGrCrUrArUrUrGrGrUrC | 2xPS-OMe | - | 40 | 20 | CCUUGUCAAGGCUAUUGGUC (SEQ ID NO: 1002) |
| 1065 | mUmAmArUrUrUrCrUrArCrUrCrUrUrGrUrArGrArUrCrUrCrUrUrGrUrCrArArGrGrCrUrArUrUrGrGrUrC | 3xOMe | - | 40 | 20 | CCUUGUCAAGGCUAUUGGUC (SEQ ID NO: 1002) |
| 1066 | mU*mA*mA*rUrUrUrCrUrArCrUrCrUrUrGrUrArGrArUrCrUrCrUrUrGrUrCrArArGrGrCrUrArUrUrGrGrUrC | 3xPS-OMe | - | 40 | 20 | CCUUGUCAAGGCUAUUGGUC (SEQ ID NO: 1002) |
| 1067 | A*T*GTGTTTTTGTCAAAAGACCTTTTrUrArArUrUrUrCrUrArCrUrCrUrUrGrUrArGrArUrCrUrCrUrUrGrUrCrArArGrGrCrUrArUrUrGrGrUrC | +25 DNA + 2xPS | - | 65 | 20 | CCUUGUCAAGGCUAUUGGUC (SEQ ID NO: 1002) |
| 1068 | A*T*GTGTTTTTGTCAAAAGACCTTTTrUrArArUrUrUrCrUrArCrUrCrUrUrGrUrArGrArUrCrUrCrUrUrGrUrCrArArGrGrCrUrArUrUrGrGrUrC*mA | +25 DNA + 2xPS | 1xPS-OMe | 66 | 21 | CCUUGUCAAGGCUAUUGGUCA (SEQ ID NO: 1254) |
| 1069 | rUrArArUrUrUrCrUrArCrUrCrUrUrGrUrArGrArUrCrUrCrUrUrGrUrCrArArGrGrCrUrArUrUrGrGrUrC*mA | - | 1xPS-OMe | 41 | 21 | CCUUGUCAAGGCUAUUGGUCA (SEQ ID NO: 1254) |
| 1070 | rUrArArUrUrUrCrUrArCrUrCrUrUrGrUrArGrArUrCrUrCrUrUrGrUrCrArArGrGrCrUrArUrUrGrGrUrCmA*rU | - | 1xPS-OMe + rU | 42 | 21 | CCUUGUCAAGGCUAUUGGUCA (SEQ ID NO: 1254) |
| 1071 | rUrArArUrUrUrCrUrArCrUrCrUrUrGrUrArGrArUrCrUrCrUrUrGrUrCrArArGrGrCrUrArUrUrGrGrUrCrU | - | rU | 41 | 20 | CCUUGUCAAGGCUAUUGGUC (SEQ ID NO: 1002) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1072 | rUrArArUrUrUrCrUrArCrUrCrUrUrGrUrArGrArUrCrCrUrUrGrUrCrArArGrGrCrUrArUrUrGrGrUrCrArU | - | rU | 42 | 21 | CCUUGUCAAGGCUAUUGGUCA (SEQ ID NO: 1254) |
| 1073 | rUrArArUrUrUrCrUrArCrUrCrUrUrGrUrArGrArUrCrCrUrUrGrUrCrArArGrGrCrUrArUrUrGrGrUrCrArArGrU | - | rU | 44 | 23 | CCUUGUCAAGGCUAUUGGUCAAG (SEQ ID NO: 1258) |
| 1074 | A*T*GTGTTTTTGTCAAAAGACCTTTTrUrArArUrUrUrCrUrArCrUrCrUrUrGrUrArGrArUrCrCrUrUrGrUrCrArArGrGrCrUrArUrUrGrGrUrCrU | +25 DNA + 2xPS | rU | 66 | 20 | CCUUGUCAAGGCUAUUGGUC (SEQ ID NO: 1002) |
| 1075 | A*T*GTGTTTTTGTCAAAAGACCTTTTrUrArArUrUrUrCrUrArCrUrCrUrUrGrUrArGrArUrCrCrUrUrGrUrCrArArGrGrCrUrArUrUrGrGrUrCrArArGrU | +25 DNA + 2xPS | rU | 69 | 23 | CCUUGUCAAGGCUAUUGGUCAAG (SEQ ID NO: 1258) |
| 1076 | rUrArArUrUrUrCrUrArCrUrCrUrUrGrUrArGrArUrCrCrUrUrGrUrCrArArGrGrCrUrArUrUrGrGrUrCrA | - | - | 41 | 21 | CCUUGUCAAGGCUAUUGGUCA (SEQ ID NO: 1254) |
| 1077 | rUrArArUrUrUrCrUrArCrUrCrUrUrGrUrArGrArUrCrCrUrUrGrUrCrArArGrGrCrUrArUrUrGrGrUrCrArArG | - | - | 43 | 23 | CCUUGUCAAGGCUAUUGGUCAAG (SEQ ID NO: 1258) |
| 1078 | A*T*GTGTTTTTGTCAAAAGACCTTTTrUrArArUrUrUrCrUrArCrUrCrUrUrGrUrArGrArUrCrCrUrUrGrUrCrArArGrGrCrUrArUrUrGrGrUrCrArArG | +25 DNA + 2xPS | - | 68 | 23 | CCUUGUCAAGGCUAUUGGUCAAG (SEQ ID NO: 1258) |
| 1079 | rUrArArUrUrUrCrUrArCrUrCrUrUrGrUrArGrArUrCrCrUrUrGrUrCrArArGrGrCrUrArUrUrGrGrUrCrUrUrUrU | - | 4xrU | 44 | 20 | CCUUGUCAAGGCUAUUGGUC (SEQ ID NO: 1002) |
| 1080 | rUrArArUrUrUrCrUrArCrUrCrUrUrGrUrArGrArUrCrCrUrUrGrUrCrArArGrGrCrUrArUrUrGrGrUrCmU*mU*mU*rU | - | 3xPS-OMe-U + rU | 44 | 20 | CCUUGUCAAGGCUAUUGGUC (SEQ ID NO: 1002) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1081 | A*T*GTGTTTTGT CAAAAGACCTTTTr UrArArUrUrCrUrA rCrCrUrCrUrGrUrAr GrArUrCrCrUrUrGrU rCrArArGrGrCrUrAr UrUrGrGrUrCrUrUrU rU | +25 DNA + 2×PS | 4×rU | 69 | 20 | CCUUGUCAA GGCUAUUGG UC (SEQ ID NO: 1002) |
| 1082 | AAAAAAAAAAAA AAAAAAAAAAAA ArUrArArUrUrCrU rArCrUrCrUrGrUr ArGrArUrCrUrUrG rUrCrArArGrGrCrUr ArUrUrGrGrUrC*mA | +25 A | 1×PS-OMe | 66 | 21 | CCUUGUCAA GGCUAUUGG UCA (SEQ ID NO: 1254) |
| 1083 | TTTTTTTTTTTTT TTTTTTTTTTrUrAr ArUrUrUrCrArCrU rCrUrUrGrUrArGrAr UrCrUrUrGrUrCrA rArGrGrCrUrArUrUr GrGrUrC*mA | +25 T | 1×PS-OMe | 66 | 21 | CCUUGUCAA GGCUAUUGG UCA (SEQ ID NO: 1254) |
| 1084 | C*C*GAAGTTTCT TCGGTTTTrUrArAr UrUrUrCrUrArCrUrC rUrUrGrUrArGrArUr CrCrUrUrGrUrCrArA rGrGrCrUrArUrUrGr GrUrC*mA | +20 DNA + 2×PS | 1×PS-OMe | 61 | 21 | CCUUGUCAA GGCUAUUGG UCA (SEQ ID NO: 1254) |
| 1085 | rUrArArUrUrUrCrUr ArCrUrCrUrUrGrUrA rGrArUrArArGrArCrAr GrArUrArUrUrUrGrC rArUrUrGrArG*mA | - | 1×PS-OMe | 41 | 21 | AGACAGAUA UUUGCAUUG AGA (SEQ ID NO: 1260) |
| 1086 | ATGTGTTTTGTCA AAAGACCTTTTrUr ArArUrUrUrCrUrArC rUrCrUrUrGrUrArGr ArUrArArGrArCrArGrA rUrArUrUrUrGrCrAr UrUrGrArG*mA | +25 DNA | 1×PS-OMe | 66 | 21 | AGACAGAUA UUUGCAUUG AGA (SEQ ID NO: 1260) |
| 1087 | C*C*GAAGTTTCT TCGGTTTTrUrArAr UrUrUrCrUrArCrUrC rUrUrGrUrArGrArUr ArGrArCrArGrArUrA rUrUrUrGrCrArUrUG rArG*mA | +20 DNA + 2×PS | 1×PS-OMe | 61 | 21 | AGACAGAUA UUUGCAUUG AGA (SEQ ID NO: 1260) |
| 1088 | rUrArArUrUrUrCrUr ArCrUrCrUrUrGrUrA rGrArUrCrArUrUrGr ArGrArUrArGrUrGrU rGrGrGrGrArA*mG | - | 1×PS-OMe | 41 | 21 | CAUUGAGAU AGUGUGGGG AAG (SEQ ID NO: 1262) |
| 1089 | ATGTGTTTTGTCA AAAGACCTTTTrUr ArArUrUrUrCrUrArC rUrCrUrUrGrUrArGr ArUrCrArUrUrGrArG rArUrArGrUrGrUrGr GrGrGrArA*mG | +25 DNA | 1×PS-OMe | 66 | 21 | CAUUGAGAU AGUGUGGGG AAG (SEQ ID NO: 1262) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1090 | C*C*GAAGTTTTCT TCGGTTTTrUrArAr UrUrCrUrArCrUrC rUrUrGrUrArGrArUr CrArUrGrArGrArUr rArGrUrGrUrGrGr GrArA*mG | +20 DNA + 2xPS | 1xPS-OMe | 61 | 21 | CAUUGAGAU AGUGUGGGG AAG (SEQ ID NO: 1262) |
| 1091 | rUrArArUrUrCrUr ArCrUrCrUrUrGrUrA rGrArUrCrUrUrCrUr CrCrCrArUrCrArUrA rGrArGrGrArU*mA | - | 1xPS-OMe | 41 | 21 | CUUCUCCCAU CAUAGAGGA UA (SEQ ID NO: 1264) |
| 1092 | ATGTGTTTTGTCA AAAGACCTTTTrUr ArArUrUrCrUrArC rUrCrUrUrGrUrArGr ArUrCrUrUrCrUrCrC rCrArUrCrArUrArGr ArGrGrArU*mA | +25 DNA | 1xPS-OMe | 66 | 21 | CUUCUCCCAU CAUAGAGGA UA (SEQ ID NO: 1264) |
| 1093 | C*C*GAAGTTTTCT TCGGTTTTrUrArAr UrUrCrUrArCrUrC rUrUrGrUrArGrArUr CrUrUrCrUrCrCrCrA rUrCrArUrArGrArGr GrArU*mA | +20 DNA + 2xPS | 1xPS-OMe | 61 | 21 | CUUCUCCCAU CAUAGAGGA UA (SEQ ID NO: 1264) |
| 1098 | A*T*GTGTTTTGT CAAAAGACCTTTTr UrArArUrUrUrCrUrA rCrUrCrUrUrGrUrAr GrArUrCrUrUrGrU rCrArArGrGrCrUrAr UrUrGrGrUrCmA*rU | +25 DNA + 2xPS | 1xPS-OMe + rU | 67 | 21 | CCUUGUCAA GGCUAUUGG UCA (SEQ ID NO: 1254) |
| 1099 | A*T*GTGTTTTGT CAAAAGACCTTTTr UrArArUrUrUrCrUrA rCrUrCrUrUrGrUrAr GrArUrCrUrUrGrU rCrArArGrGrCrUrAr UrUrGrGrUrCmA*m A*rU | +25 DNA + 2xPS | 2xPS-OMe + rU | 68 | 22 | CCUUGUCAA GGCUAUUGG UCAA (SEQ ID NO: 1256) |
| 1100 | A*T*GTGTTTTGT CAAAAGACCTTTTr UrArArUrUrUrCrUrA rCrUrCrUrUrGrUrAr GrArUrCrUrUrGrU rCrArArGrGrCrUrAr UrUrGrGrUrCmC*rU | +25 DNA + 2xPS | 1xPS-OMe + rU | 66 | 20 | CCUUGUCAA GGCUAUUGG UC (SEQ ID NO: 1002) |
| 1101 | A*T*GTGTTTTGT CAAAAGACCTTTTr UrArArUrUrUrCrUrA rCrUrCrUrUrGrUrAr GrArUrCrUrUrGrU rCrArArGrGrCrUrAr UrUrGrGrU*mC | +25 DNA + 2xPS | 1xPS-OMe | 65 | 20 | CCUUGUCAA GGCUAUUGG UC (SEQ ID NO: 1002) |
| 1102 | A*T*GTGTTTTGT CAAAAGACCTTTTr UrArArUrUrUrCrUrA rCrUrCrUrUrGrUrAr GrArUrCrUrUrGrU rCrArArGrGrCrUrAr UrUrGrGrUrC*mA* mA | +25 DNA + 2xPS | 2xPS-OMe | 67 | 22 | CCUUGUCAA GGCUAUUGG UCAA (SEQ ID NO: 1256) |

TABLE 19-continued

Cpf1 guide RNAs

| gRNA Sequence SEQ ID NO. | gRNA Sequence | 5' mod.** | 3' mod. | Length of crRNA + gRNA targeting domain | Length of gRNA targeting domain | gRNA Targeting Domain (RNA) |
|---|---|---|---|---|---|---|
| 1103 | mA*mU*rGrUrGrUr UrUrUrUrGrUrCrArA rArArGrArCrCrUrUr UrUrUrArArUrUrUrC rUrArCrUrCrUrUrGr UrArGrArUrCrCrUrU rGrUrCrArArGrGrCr UrArUrUrGrGrUrC* mA | +25 RNA + 2xPS | 1xPS-OMe | 66 | 21 | CCUUGUCAA GGCUAUUGG UCA (SEQ ID NO: 1254) |
| 1104 | mA*mA*rArArArAr ArArArArArArArArA rArArArArArArArAr ArArUrArArUrUrUrC rUrArCrUrCrUrUrGr UrArGrArUrCrCrUrU rGrUrCrArArGrGrCr UrArUrUrGrGrUrC* mA | PolyA RNA + 2xPS | 1xPS-OMe | 66 | 21 | CCUUGUCAA GGCUAUUGG UCA (SEQ ID NO: 1254) |
| 1105 | mU*mU*rUrUrUrUr UrUrUrUrUrUrUrUrU rUrUrUrUrUrUrUrUr UrUrUrArArUrUrUrC rUrArCrUrCrUrUrGr UrArGrArUrCrCrUrU rGrUrCrArArGrGrCr UrArUrUrGrGrUrC* mA | PolyU RNA + 2xPS | 1xPS-OMe | 66 | 21 | CCUUGUCAA GGCUAUUGG UCA (SEQ ID NO: 1254) |

All bases are in upper case
Lowercase "r" represents RNA, 2'-hydroxy; bases notmodified by an "r" are DNA
All bases are linked via standard phosphodiester bonds except as noted:
"*" represents phosphorothioatemodification
"PS" represents phosphorothioate modification
"PS2" represents phosphorodithioate modification
"OMe" represents a 2'-o-methylmodification
"m" represents a 2'-o-methylmodification
**Table 24 provides a listing of the sequences of the gRNA 5' extensions

SEQUENCES

Genome editing system components according to the present disclosure (including without limitation, RNA-guided nucleases, guide RNAs, donor template nucleic acids, nucleic acids encoding nucleases or guide RNAs, and portions or fragments of any of the foregoing), are exemplified by the nucleotide and amino acid sequences presented in the Sequence Listing. The sequences presented in the Sequence Listing are not intended to be limiting, but rather illustrative of certain principles of genome editing systems and their component parts, which, in combination with the instant disclosure, will inform those of skill in the art about additional implementations and modifications that are within the scope of this disclosure. A list of the sequences presented is provided in the following Table 25.

TABLE 25

Sequences presented in the Sequence Listing:

| SEQ ID NOS: | DESCRIPTION |
|---|---|
| 1-2, 4-6, 12, 14 | Cas9 polypeptides |
| 3, 7-11, 13 | Cas9 coding sequences |

TABLE 25-continued

Sequences presented in the Sequence Listing:

| SEQ ID NOS: | DESCRIPTION |
|---|---|
| 15-23, 52-123 | Cas9 RuvC-like domains |
| 24-28, 124-198 | Cas9 HNH-like domains |
| 29-31, 38-51 | Full-length modular and unimolecular gRNAs |
| 32-37 | gRNA proximal and tail domains |
| 199-205 | PAM sequences |
| 251-901, 1002 | gRNA targeting domains (RNA)- see Table 2, 19, 22, 23 |
| 910-919, 943-945, 956-959, 1003 | gRNA targeting domains (DNA)- see Tables 7, 9 |
| 920-929, 946-948, 960-963, 1004 | gRNA targeting domains plus PAM (NGG) (RNA)-see Tables 7, 9 |
| 930-939, 949-951, 964-967, 1005 | gRNA targeting domains plus PAM (NGG) (DNA)-see Tables 7, 9 |
| 970, 971, 996, 997 | gRNA sequences (DNA)- see Tables 10, 12 |

TABLE 25-continued

Sequences presented in the Sequence Listing:

| SEQ ID NOS: | DESCRIPTION |
|---|---|
| 972, 973, 998, 999 | gRNA sequences (DNA)- see Tables 10, 12 |
| 902, 903 | Human HBG1 and HBG2 promoter sequences including HPFH deletion site |
| 904-909, 974-995 | Oligonucleotide donor sequences and homology arms-see Tables 8, 11 |
| 968-969 | BCL11Ae sequences |
| 1006, 1007 | Nuclear Localization Signal sequences |
| 1000, 1001, 1008-1018 1032-1039 1094-1097, 1107-1109 | Cpf1 polypeptide sequences |
| 1019-1021 1110-1117 | Cpf1 nucleotide sequences |

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments described herein. Such equivalents are intended to be encompassed by the following claims.

REFERENCES

Ahern et al., Br J Haematol 25(4):437-444 (1973)
Akinbami Hemoglobin 40:64-65 (2016)
Aliyu et al. Am J Hematol 83:63-70 (2008)
Anders et al. Nature 513(7519):569-573 (2014)
Angastiniotis & Modell Ann N Y Acad Sci 850:251-269 (1998)
Bae et al. Bioinformatics 30(10):1473-1475 (2014)
Barbosa et al. Braz J Med Bio Res 43(8):705-711 (2010)
Bouva Hematologica 91(1):129-132 (2006)
Briner et al. Mol Cell 56(2):333-339 (2014)
Brousseau Am J Hematol 85(1):77-78 (2010)
Caldecott Nat Rev Genet 9(8):619-631 (2008)
Canvers et al. Nature 527(12):192-197 (2015)
Chang et al. Mol Ther Methods Clin Dev 4:137-148 (2017)
Chassanidis Ann Hematol 88(6):549-555 (2009)
Chylinski et al. RNA Biol 10(5):726-737 (2013)
Cong et al. Science 399(6121):819-823 (2013)
Costa et al., Cad Saude Publica 18(5):1469-1471 (2002)
Davis & Maizels 2 Proc Natl Acad Sci USA 111(10):E924-932 (2014)
Fine et al. Sci Rep. 5:10777 (2015)
Frit et al. DNA Repair (Amst) 17:81-97 (2014)
Fu et al. Nat Biotechnol 32:279-284 (2014)
Gao et al. Nat Biotechnol.: 35(8):789-792 (2017)
Giarratana et al. Blood:118, 5071-5079 (2011)
Guilinger et al. Nat Biotechnol 32:577-582 (2014)
Heigwer et al. Nat Methods 11(2):122-123 (2014)
Hsu et al. Nat Biotechnol 31(9):827-832 (2013)
Iyama & Wilson DNA Repair (Amst) 12(8):620-636 (2013)
Jiang et al. Nat Biotechnol 31(3):233-239 (2013)
Jinek et al. Science 337(6096):816-821 (2012)
Jinek et al. Science 343(6176):1247997 (2014)
Kleinstiver et al. Nature 523(7561):481-485 (2015a)
Kleinstiver et al. Nat Biotechnol 33(12):1293-1298 (2015b)
Kleinstiver et al. Nature 529(7587):490-495 (2016)
Komor et al. Nature 533(7603):420-424 (2016)
Lee et al. Nano Lett 12(12):6322-6327 (2012)
Lewis "Medical-Surgical Nursing: Assessment and Management of Clinical Problems" (2014)
Li Cell Res 18(1):85-98 (2008)
Makarova et al. Nat Rev Microbiol 9(6):467-477 (2011)
Mali et al. Science 339(6121):823-826 (2013)
Mantovani et al. Nucleic Acids Res 16(16):7783-7797 (1988)
Marteijn et al. Nat Rev Mol Cell Biol 15(7):465-481 (2014)
Martyn et al., Biochim Biophys Acta 1860(5):525-536 (2017)
Nishimasu et al. Cell 156(5):935-949 (2014)
Nishimasu et al. Cell 162:1113-1126 (2015)
Notta et al. Science 333(6039):218-21 (2011)
Ran & Hsu Cell 154(6):1380-1389 (2013)
Richardson et al. Nat Biotechnol 34:339-344 (2016)
Shmakov et al. Molecular Cell 60(3):385-397 (2015)
Sternberg et al. Nature 507(7490):62-67 (2014)
Superti-Furga et al. EMBO J 7(10):3099-3107 (1988)
Thein Hum Mol Genet 18(R2):R216-223 (2009)
Tsai et al. Nat Biotechnol 34(5): 483 (2016)
Waber et al. Blood 67(2):551-554 (1986)
Wang et al. Cell 153(4):910-918 (2013)
Xiao et al. Bioinformatics 30(8):1180-1182(2014)
Xu et al. Genes Dev 24(8):783-798 (2010)
Yamano et al. Cell 165(4): 949-962 (2016)
Zetsche et al. Nat Biotechnol 33(2):139-42 (2015)

SEQUENCE LISTING (1270 sequences)

SEQ ID NO: 1 - protein, 1345 aa, Streptococcus mutans
  misc_feature (10)..(21): N-terminal RuvC-like domain
  misc_feature (759)..(766): RuvC-like domain
  misc_feature (837)..(863): HNH-like domain
  misc_feature (982)..(989): RuvC-like domain
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1368 aa, Streptococcus pyogenes [sequence omitted]

SEQ ID NO: 3 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 4 - protein, 1388 aa, Streptococcus thermophilus
  misc_feature (10)..(21): N-terminal RuvC-like domain
  misc_feature (760)..(767): RuvC-like domain
  misc_feature (844)..(870): HNH-like domain
  misc_feature (989)..(996): RuvC-like domain
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 5 - protein, 1334 aa, Listeria innocua
  misc_feature (10)..(21): N-terminal RuvC-like domain
  misc_feature (762)..(769): RuvC-like domain
  misc_feature (840)..(866): HNH-like domain
  misc_feature (985)..(992): RuvC-like domain
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 8 - DNA, 3159 bp, Staphylococcus aureus
atgaagcggaactacatcctgggcctggacatcggcatcaccagcgtgggctacggcatcatcgactacgagacacgggacgtgatcgatgccggcgtgcggctgttcaaagaggccaacgtggaaaacaacgagggcaggcggagcaagagaggcgccagaaggctgaagcggcggaggcggcatagaatccagagagtgaagaagctgctgttcgactacaacctgctgaccgaccacagcgagctgagcggcatcaacccctacgaggccagagtgaagggcctgagccagaagctgagcgaggaagagttctctgccgccctgctgcacctggccaagagaagaggcgtgcacaacgtgaacgaggtggaagaggacaccggcaacgagctgtccaccaaagagcagatcagccggaacagcaaggccctggaagagaaatacgtggccgaactgcagctggaacggctgaagaaagacggcgaagtgcggggcagcatcaacagattcaagaccagcgactacgtgaaagaagccaaacagctgctgaaggtgcagaaggcctaccaccagctggaccagagcttcatcgacacctacatcgacctgctggaaacccggcggacctactatgagggacctggcgagggcagccccttcggctggaaggacatcaaagaatggtacgagatgctgatgggccactgcacctacttccccgaggaactgcggagcgtgaagtacgcctacaacgccgacctgtacaacgccctgaacgacctgaacaatctcgtgatcaccagggacgagaacgagaagctggaatattacgagaagttccagatcatcgagaacgtgttcaagcagaagaagaagcccaccctgaagcagatcgccaaagaaatcctcgtgaacgaagaggatattaagggctacagagtgaccagcaccggcaagcccgagttcaccaacctgaaggtgtaccacgacatcaaggacattaccgcccggaaagagattattgagaacgccgagctgctggatcagattgccaagatcctgaccatctaccagagcagcgaggacatccaggaagaactgaccaatctgaactccgagctgacccaggaagagatcgagcagatctctaatctgaagggctataccggcacccacaacctgagcctgaaggccatcaacctgatcctggacgagctgtggcacaccaacgacaaccagatcgctatcttcaaccggctgaagctggtgcccaagaaggtggacctgtcccagcagaaagagatccccaccaccctggtggacgacttcatcctgagccccgtcgtgaagagaagcttcatccagagcatcaaagtgatcaacgccatcatcaagaagtacggcctgcccaacgacatcattatcgagctggcccgcgagaagaactccaaggacgcccagaaaatgatcaacgagatgcagaagcggaaccggcagaccaacgagcggatcgaggaaatcatccggaccaccggcaaagagaacgccaagtacctgatcgagaagatcaagctgcacgacatgcaggaaggcaagtgcctgtacagcctggaagccatccctctggaagatctgctgaacaaccccttcaactatgaggtggaccacatcatccccagaagcgtgtccttcgacaacagcttcaacaacaaggtgctcgtgaagcaggaagaaaacagcaagaagggcaaccggaccccattccagtacctgagcagcagcgacagcaagatcagctacgaaaccttcaagaagcacatcctgaatctggccaagggcaagggcagaatcagcaagaccaagaaagagtatctgctggaagaacgggacatcaacaggttctccgtgcagaaagacttcatcaaccggaacctggtggataccagatacgccaccagaggcctgatgaacctgctgcggagctacttcagagtgaacaacctggacgtgaaagtgaagtccatcaatggcggcttcaccagctttctgcggcggaagtggaagtttaagaaagagcggaacaaggggtacaagcaccacgccgaggacgccctgatcattgccaacgccgatttcatcttcaaagagtggaagaaactggacaaggccaaaaaagtgatggaaaaccagatgttcgaggaaaagcaggccgagagcatgcccgagatcgaaaccgagcaggagtacaaagagatcttcatcaccccccaccagatcaagcacattaaggacttcaaggactacaagtacagccaccgggtggacaagaagcctaatagagagctgattaacgacaccctgtactccacccggaaggacgacaagggcaacaccctgatcgtgaacaatctgaacggcctgtacgacaaggacaatgacaagctgaaaaagctgatcaacaagagccccgaaaagctgctgatgtaccaccacgacccccagacctaccagaaactgaagctgattatggaacagtacggcgacgagaagaatcccctgtacaagtactacgaggaaaccgggaactacctgaccaagtactccaaaaaggacaacggccccgtgatcaagaagattaagtattacggcaacaaactgaacgcccatctggacatcaccgacgactaccccaacagcagaaacaaggtcgtgaagctgtccctgaagccctacagattcgacgtgtacctggacaatggcgtgtacaagttcgtgaccgtgaagaatctggatgtgatcaaaaaagaaaactactacgaagtgaatagcaagtgctatgaggaagctaagaagctgaagaagatcagcaaccaggccgagtttatcgcctccttctacaacaacgatctgatcaagatcaacggcgagctgtatagagtgatcggcgtgaacaacgacctgctgaaccggatcgaagtgaacatgatcgacatcacctaccgcgagtacctggaaaacatgaacgacaagaggccccccaggatcattaagacaatcgcctccaagacccagagcattaagaagtacagcacagacattctgggcaacctgtatgaagtgaaatctaagaagcaccctcagatcatcaaaaagggc

SEQ ID NO: 9 - DNA, 3159 bp, Staphylococcus aureus
atgaagcgcaactacatcctcggactggacatcggcattacctccgtgggatacggcatcatcgattacgaaactagggatgtgatcgacgctggagtcaggctgttcaaagaggcgaacgtggagaacaacgaggggcggcgctcaaagaggggggcccgccggctgaagcgccgccgcagacatagaatccagcgcgtgaagaagctgctgttcgactacaaccttctgaccgaccactccgaactttccggcatcaacccatatgaggctagagtgaagggattgtcccaaaagctgtccgaggaagagttctccgccgcgttgctccacctcgccaagcgcaggggagtgcacaatgtgaacgaagtggaagaagataccggaaacgagctgtccaccaaggagcagatcagccggaactccaaggccctggaagagaaatacgtggcggaactgcaactggagcggctgaagaaagacggagaagtgcgcggctcgatcaaccgcttcaagacctcggactacgtgaaggaggccaagcagctcctgaaagtgcaaaaggcctatcaccaacttgaccagtcctttatcgatacctacatcgatctgctcgagactcggcggacttactacgagggtccaggggagggctccccatttggttggaaggatattaaggagtggtacgaaatgctgatgggacactgcacatacttccctgaggagctgcggagcgtgaaatacgcatacaacgcagacctgtacaacgcgctgaacgacctgaacaatctcgtgatcacccgggacgagaacgaaaagctcgagtattacgaaaagttccagattattgagaacgtgttcaaacagaagaagaagccgacactgaagcagattgccaaggaaatcctcgtgaacgaagaggacatcaagggctatcgagtgacctcaacgggaaagccggagttcaccaatctgaaggtctaccacgacatcaaagacattaccgcccggaaggagatcattgagaacgcggagctgttggaccagattgcgaagattctgaccatctaccaatcctccgaggatattcaggaagaactcaccaacctcaacagcgaactgacccaggaggagatagagcaaatctccaacctgaagggctacaccggaactcataacctgagcctgaaggccatcaacttgatcctggacgagctgtggcacaccaacgataaccagatcgctattttcaatcggctgaagctggtccccaagaaagtggacctctcacaacaaaaggagatccctactacccttgtggacgatttcattctgtcccccgtggtcaagagaagcttcatacagtcaatcaaagtgatcaatgccattatcaagaaatacggtctgcccaacgacattatcattgagctcgcccgcgagaagaactcgaaggacgcccagaagatgattaacgaaatgcagaagaggaaccgacagactaacgaacggatcgaagaaatcatccggaccaccgggaaggaaaacgcgaagtacctgatcgaaaagatcaagctccatgacatgcaggaaggaaagtgtctgtactcgctggaggccattccgctggaggacttgctgaacaacccttttaactacgaagtggatcatatcattccgaggagcgtgtcattcgacaattccttcaacaacaaggtcctcgtgaagcaggaggaaaactcgaagaagggaaaccgcacgccgttccagtacctgagcagcagcgactccaagatttcctacgaaaccttcaagaagcacatcctcaacctggcaaaggggaagggtcgcatctccaagaccaagaaggaatatctgctggaagaaagagacatcaacagattctccgtgcaaaaggacttcatcaaccgcaacctcgtggatactagatacgctactcggggtctgatgaacctcctgagaagctactttagagtgaacaatctggacgtgaaggtcaagtcgattaacggaggtttcacctccttcctgcggcgcaagtggaagttcaagaaggaacggaacaagggctacaagcaccacgccgaggacgccctgatcattgccaacgccgacttcatcttcaaagaatggaagaaacttgacaaggctaagaaggtcatggaaaaccagatgttcgaagaaaagcaggccgagtctatgcctgaaatcgagactgaacaggagtacaaggaaatctttattacgccacaccagatcaaacacatcaaggatttcaaggattacaagtactcacatcgcgtggacaaaaagccgaacagggaactgatcaacgacaccctctactccacccggaaggatgacaaagggaataccctcatcgtcaacaaccttaacggcctgtacgacaaggacaacgataagctgaagaagctcattaacaagtcgcccgaaaagttgctgatgtaccaccacgaccctcagacttaccagaagctcaagctgatcatggagcagtatggggacgagaaaaacccgttgtacaagtactacgaagaaactgggaattatctgactaagtactccaagaaagataacggccccgtgattaagaagattaagtactacggcaacaagctgaacgcccatctggacatcaccgatgactaccctaattcccgcaacaaggtcgtcaagctgagcctcaagccctaccggtttgatgtgtaccttgacaatggagtgtacaagttcgtgactgtgaagaaccttgacgtgatcaagaaggagaactactacgaagtcaactccaagtgctacgaggaagcaaagaagttgaagaagatctcgaaccaggccgagttcattgcctccttctataacaacgacctgattaagatcaacggcgaactgtaccgcgtcattggcgtgaacaacgatctcctgaaccgcatcgaagtgaacatgatcgacatcacttaccgggaatacctggagaatatgaacgacaagcgcccgccccggatcattaagactatcgcctcaaagacccagtcgatcaagaagtacagcaccgacatcctgggcaacctgtacgaggtcaaatcgaagaagcacccccagatcatcaagaaggga

SEQ ID NO: 10 - DNA, 3159 bp, Staphylococcus aureus
atgaaaaggaactacattctggggctggccatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 11 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagaggcctctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 12 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 13 - DNA, 3249 bp, Neisseria meningitidis
  misc_feature (1)..(3249): Exemplary codon optimized Cas9
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 14 - protein, 859 aa, Artificial Sequence
  Synthetic Cas9 consensus sequence derived from Sm, Sp, St, and Li Cas9 sequences
  misc_feature (4)..(4): Xaa can be any naturally occurring amino acid
  misc_feature (8)..(18): N-terminal RuvC-like domain
  misc_feature (21)..(21): Xaa can be any naturally occurring amino acid
  misc_feature (23)..(23): Xaa can be any naturally occurring amino acid
  misc_feature (24)..(24): Xaa can be any naturally occurring amino acid
  misc_feature (26)..(26): Xaa can be any naturally occurring amino acid
  misc_feature (29)..(31): Each Xaa can independently be any naturally occurring amino acid
  misc_feature (33)..(33): Xaa can be any naturally occurring amino acid
  misc_feature (36)..(36): Xaa can be any naturally occurring amino acid
  misc_feature (45)..(45): Xaa can be any naturally occurring amino acid
  misc_feature (54)..(54): Xaa can be any naturally occurring amino acid
  misc_feature (63)..(63): Xaa can be any naturally occurring amino acid
  misc_feature (71)..(71): Xaa can be any naturally occurring amino acid
  misc_feature (75)..(75): Xaa can be any naturally occurring amino acid
  misc_feature (76)..(76): Xaa can be any naturally occurring amino acid
  misc_feature (78)..(80): Each Xaa can independently be any naturally occurring amino acid
  misc_feature (82)..(82): Xaa can be any naturally occurring amino acid
  misc_feature (84)..(84): Xaa can be any naturally occurring amino acid
  misc_feature (85)..(85): Xaa can be any naturally occurring amino acid
  misc_feature (89)..(89): Xaa can be any naturally occurring amino acid
  misc_feature (90)..(90): Xaa can be any naturally occurring amino acid
  misc_feature (98)..(98): Xaa can be any naturally occurring amino acid
  misc_feature (100)..(100): Xaa can be any naturally occurring amino acid
  misc_feature (106)..(106): Xaa can be any naturally occurring amino acid
  misc_feature (113)..(113): Xaa can be any naturally occurring amino acid
  misc_feature (116)..(116): Xaa can be any naturally occurring amino acid
  misc_feature (125)..(125): Xaa can be any naturally occurring amino acid
  misc_feature (126)..(126): Xaa can be any naturally occurring amino acid
  misc_feature (128)..(133): Each Xaa can independently be any naturally occurring amino acid
  misc_feature (135)..(135): Xaa can be any naturally occurring amino acid
  misc_feature (137)..(137): Xaa can be any naturally occurring amino acid
  misc_feature (139)..(147): Each Xaa can independently be any naturally occurring amino acid
  misc_feature (153)..(155): Each Xaa can independently be any naturally occurring amino acid
  misc_feature (157)..(157): Xaa can be any naturally occurring amino acid
  misc_feature (159)..(159): Xaa can be any naturally occurring amino acid
  misc_feature (161)..(161): Xaa can be any naturally occurring amino acid
  misc_feature (163)..(163): Xaa can be any naturally occurring amino acid
  misc_feature (166)..(168): Each Xaa can independently be any naturally occurring amino acid
  misc_feature (170)..(170): Xaa can be any naturally occurring amino acid
  misc_feature (171)..(171): Xaa can be any naturally occurring amino acid
  misc_feature (173)..(175): Each Xaa can independently be any naturally occurring amino acid
  misc_feature (177)..(177): Xaa can be any naturally occurring amino acid
  misc_feature (183)..(183): Xaa can be any naturally occurring amino acid
  misc_feature (185)..(187): Each Xaa can independently be any naturally occurring amino acid
  misc_feature (189)..(189): Xaa can be any naturally occurring amino acid
  misc_feature (192)..(195): Each Xaa can independently be any naturally occurring amino acid
  misc_feature (198)..(198): Xaa can be any naturally occurring amino acid
  misc_feature (199)..(199): Xaa can be any naturally occurring amino acid
  misc_feature (202)..(202): Xaa can be any naturally occurring amino acid
  misc_feature (206)..(206): Xaa can be any naturally occurring amino acid
  misc_feature (207)..(207): Xaa can be any naturally occurring amino acid
  misc_feature (210)..(210): Xaa can be any naturally occurring amino acid
  misc_feature (212)..(212): Xaa can be any naturally occurring amino acid
  misc_feature (213)..(213): Xaa can be any naturally occurring amino acid
  misc_feature (219)..(219): Xaa can be any naturally occurring amino acid
  misc_feature (220)..(220): Xaa can be any naturally occurring amino acid
  misc_feature (222)..(222): Xaa can be any naturally occurring amino acid
  misc_feature (224)..(224): Xaa can be any naturally occurring amino acid
  misc_feature (226)..(226): Xaa can be any naturally occurring amino acid
  misc_feature (236)..(236): Xaa can be any naturally occurring amino acid
  misc_feature (240)..(240): Xaa can be any naturally occurring amino acid
  misc_feature (241)..(241): Xaa can be any naturally occurring amino acid
  misc_feature (244)..(246): Each Xaa can independently be any naturally occurring amino acid
  misc_feature (248)..(248): Xaa can be any naturally occurring amino acid
  misc_feature (249)..(249): Xaa can be any naturally occurring amino acid
  misc_feature (250)..(250): Xaa can be any naturally occurring amino acid
  misc_feature (252)..(254): Each Xaa can independently be any naturally occurring amino acid
  misc_feature (256)..(256): Xaa can be any naturally occurring amino acid
  misc_feature (257)..(257): Xaa can be any naturally occurring amino acid
  misc_feature (268)..(268): Xaa can be any naturally occurring amino acid
  misc_feature (271)..(271): Xaa can be any naturally occurring amino acid
  misc_feature (273)..(273): Xaa can be any naturally occurring amino acid
  misc_feature (277)..(277): Xaa can be any naturally occurring amino acid
  misc_feature (280)..(280): Xaa can be any naturally occurring amino acid
  misc_feature (281)..(281): Xaa can be any naturally occurring amino acid
  misc_feature (283)..(283): Xaa can be any naturally occurring amino acid
  misc_feature (289)..(289): Xaa can be any naturally occurring amino acid
  misc_feature (290)..(290): Xaa can be any naturally occurring amino acid
  misc_feature (292)..(294): Each Xaa can independently be any naturally occurring amino acid
  misc_feature (301)..(301): Xaa can be any naturally occurring amino acid
  misc_feature (308)..(308): Xaa can be any naturally occurring amino acid
  misc_feature (319)..(322): Each Xaa can independently be any naturally occurring amino acid
  misc_feature (328)..(328): Xaa can be any naturally occurring amino acid
  misc_feature (329)..(329): Xaa can be any naturally occurring amino acid
  misc_feature (335)..(337): Each Xaa can independently be any naturally occurring amino acid
  misc_feature (346)..(346): Xaa can be any naturally occurring amino acid
  misc_feature (347)..(347): Xaa can be any naturally occurring amino acid
  misc_feature (356)..(361): Each Xaa can independently be any naturally occurring amino acid
  misc_feature (363)..(363): Xaa can be any naturally occurring amino acid
  misc_feature (370)..(373): Each Xaa can independently be any naturally occurring amino acid
  misc_feature (375)..(375): Xaa can be any naturally occurring amino acid
  misc_feature (376)..(376): Xaa can be any naturally occurring amino acid
  misc_feature (379)..(379): Xaa can be any naturally occurring amino acid
  misc_feature (386)..(390): Each Xaa can independently be any naturally occurring amino acid
  misc_feature (393)..(393): Xaa can be any naturally occurring amino acid
  misc_feature (395)..(395): Xaa can be any naturally occurring amino acid
  misc_feature (396)..(396): Xaa can be any naturally occurring amino acid
  misc_feature (398)..(398): Xaa can be any naturally occurring amino acid
  misc_feature (400)..(400): Xaa can be any naturally occurring amino acid
  misc_feature (403)..(403): Xaa can be any naturally occurring amino acid
  misc_feature (407)..(407): Xaa can be any naturally occurring amino acid
  misc_feature (410)..(410): Xaa can be any naturally occurring amino acid
  misc_feature (411)..(411): Xaa can be any naturally occurring amino acid
  misc_feature (413)..(416): Each Xaa can independently be any naturally occurring amino acid
  misc_feature (418)..(418): Xaa can be any naturally occurring amino acid
  misc_feature (422)..(422): Xaa can be any naturally occurring amino acid
  misc_feature (428)..(428): Xaa can be any naturally occurring amino acid
  misc_feature (431)..(431): Xaa can be any naturally occurring amino acid
  misc_feature (433)..(433): Xaa can be any naturally occurring amino acid
  misc_feature (437)..(439): Each Xaa can independently be any naturally occurring amino acid
  misc_feature (445)..(445): Xaa can be any naturally occurring amino acid
  misc_feature (451)..(451): Xaa can be any naturally occurring amino acid
  misc_feature (456)..(456): Xaa can be any naturally occurring amino acid
  misc_feature (459)..(459): Xaa can be any naturally occurring amino acid
  misc_feature (465)..(469): Each Xaa can independently be any naturally occurring amino acid
  misc_feature (481)..(481): Xaa can be any naturally occurring amino acid
  misc_feature (482)..(482): Xaa can be any naturally occurring amino acid
  misc_feature (484)..(484): Xaa can be any naturally occurring amino acid
  misc_feature (490)..(490): Xaa can be any naturally occurring amino acid
  misc_feature (494)..(494): Xaa can be any naturally occurring amino acid
  misc_feature (495)..(502): RuvC-like domain
  misc_feature (497)..(497): Xaa can be any naturally occurring amino acid
  misc_feature (506)..(506): Xaa can be any naturally occurring amino acid
  misc_feature (510)..(510): Xaa can be any naturally occurring amino acid
  misc_feature (513)..(513): Xaa can be any naturally occurring amino acid
  misc_feature (514)..(514): Xaa can be any naturally occurring amino acid
  misc_feature (517)..(517): Xaa can be any naturally occurring amino acid
  misc_feature (520)..(520): Xaa can be any naturally occurring amino acid
  misc_feature (525)..(525): Xaa can be any naturally occurring amino acid
  misc_feature (526)..(526): Xaa can be any naturally occurring amino acid
  misc_feature (529)..(529): Xaa can be any naturally occurring amino acid
  misc_feature (531)..(531): Xaa can be any naturally occurring amino acid
  misc_feature (532)..(532): Xaa can be any naturally occurring amino acid
  misc_feature (534)..(534): Xaa can be any naturally occurring amino acid
  misc_feature (542)..(542): Xaa can be any naturally occurring amino acid
  misc_feature (546)..(546): Xaa can be any naturally occurring amino acid
  misc_feature (547)..(547): Xaa can be any naturally occurring amino acid
  misc_feature (553)..(553): Xaa can be any naturally occurring amino acid
  misc_feature (555)..(575): HNH-like domain
  misc_feature (556)..(556): Xaa can be any naturally occurring amino acid
  misc_feature (560)..(560): Xaa can be any naturally occurring amino acid
  misc_feature (563)..(563): Xaa can be any naturally occurring amino acid
  misc_feature (565)..(565): Xaa can be any naturally occurring amino acid
  misc_feature (567)..(567): Xaa can be any naturally occurring amino acid
  misc_feature (579)..(579): Xaa can be any naturally occurring amino acid
  misc_feature (582)..(582): Xaa can be any naturally occurring amino acid
  misc_feature (583)..(583): Xaa can be any naturally occurring amino acid
  misc_feature (585)..(585): Xaa can be any naturally occurring amino acid
  misc_feature (588)..(588): Xaa can be any naturally occurring amino acid
  misc_feature (590)..(590): Xaa can be any naturally occurring amino acid
  misc_feature (592)..(592): Xaa can be any naturally occurring amino acid
  misc_feature (594)..(596): Each Xaa can independently be any naturally occurring amino acid
  misc_feature (610)..(610): Xaa can be any naturally occurring amino acid
  misc_feature (616)..(616): Xaa can be any naturally occurring amino acid
  misc_feature (628)..(628): Xaa can be any naturally occurring amino acid
  misc_feature (631)..(631): Xaa can be any naturally occurring amino acid
  misc_feature (633)..(633): Xaa can be any naturally occurring amino acid
  misc_feature (634)..(634): Xaa can be any naturally occurring amino acid
  misc_feature (636)..(636): Xaa can be any naturally occurring amino acid
  misc_feature (638)..(641): Each Xaa can independently be any naturally occurring amino acid
  misc_feature (643)..(645): Each Xaa can independently be any naturally occurring amino acid
  misc_feature (653)..(653): Xaa can be any naturally occurring amino acid
  misc_feature (657)..(657): Xaa can be any naturally occurring amino acid
  misc_feature (659)..(659): Xaa can be any naturally occurring amino acid
  misc_feature (660)..(660): Xaa can be any naturally occurring amino acid
  misc_feature (665)..(665): Xaa can be any naturally occurring amino acid
  misc_feature (666)..(666): Xaa can be any naturally occurring amino acid
  misc_feature (668)..(668): Xaa can be any naturally occurring amino acid
  misc_feature (669)..(669): Xaa can be any naturally occurring amino acid
  misc_feature (670)..(677): RuvC-like domain
  misc_feature (680)..(680): Xaa can be any naturally occurring amino acid
  misc_feature (681)..(681): Xaa can be any naturally occurring amino acid
  misc_feature (683)..(683): Xaa can be any naturally occurring amino acid
  misc_feature (686)..(686): Xaa can be any naturally occurring amino acid
  misc_feature (696)..(696): Xaa can be any naturally occurring amino acid
  misc_feature (697)..(697): Xaa can be any naturally occurring amino acid
  misc_feature (704)..(704): Xaa can be any naturally occurring amino acid
  misc_feature (708)..(708): Xaa can be any naturally occurring amino acid
  misc_feature (710)..(710): Xaa can be any naturally occurring amino acid
  misc_feature (711)..(711): Xaa can be any naturally occurring amino acid
  misc_feature (714)..(714): Xaa can be any naturally occurring amino acid
  misc_feature (717)..(720): Each Xaa can independently be any naturally occurring amino acid
  misc_feature (722)..(722): Xaa can be any naturally occurring amino acid
  misc_feature (725)..(725): Xaa can be any naturally occurring amino acid
  misc_feature (727)..(727): Xaa can be any naturally occurring amino acid
  misc_feature (733)..(735): Each Xaa can independently be any naturally occurring amino acid
  misc_feature (740)..(740): Xaa can be any naturally occurring amino acid
  misc_feature (742)..(742): Xaa can be any naturally occurring amino acid
  misc_feature (749)..(754): Each Xaa can independently be any naturally occurring amino acid
  misc_feature (758)..(761): Each Xaa can independently be any naturally occurring amino acid
  misc_feature (763)..(768): Each Xaa can independently be any naturally occurring amino acid
  misc_feature (771)..(771): Xaa can be any naturally occurring amino acid
  misc_feature (774)..(777): Each Xaa can independently be any naturally occurring amino acid
  misc_feature (782)..(782): Xaa can be any naturally occurring amino acid
  misc_feature (784)..(786): Each Xaa can independently be any naturally occurring amino acid
  misc_feature (788)..(788): Xaa can be any naturally occurring amino acid
  misc_feature (790)..(790): Xaa can be any naturally occurring amino acid
  misc_feature (795)..(795): Xaa can be any naturally occurring amino acid
  misc_feature (799)..(799): Xaa can be any naturally occurring amino acid
  misc_feature (801)..(801): Xaa can be any naturally occurring amino acid
  misc_feature (802)..(802): Xaa can be any naturally occurring amino acid
  misc_feature (804)..(804): Xaa can be any naturally occurring amino acid
  misc_feature (806)..(813): Each Xaa can independently be any naturally occurring amino acid
  misc_feature (815)..(818): Each Xaa can independently be any naturally occurring amino acid
  misc_feature (820)..(820): Xaa can be any naturally occurring amino acid
  misc_feature (823)..(827): Each Xaa can independently be any naturally occurring amino acid
  misc_feature (829)..(829): Xaa can be any naturally occurring amino acid
  misc_feature (830)..(830): Xaa can be any naturally occurring amino acid
  misc_feature (832)..(832): Xaa can be any naturally occurring amino acid
  misc_feature (835)..(837): Each Xaa can independently be any naturally occurring amino acid
  misc_feature (842)..(844): Each Xaa can independently be any naturally occurring amino acid
  misc_feature (846)..(846): Xaa can be any naturally occurring amino acid
  misc_feature (848)..(848): Xaa can be any naturally occurring amino acid
  misc_feature (851)..(851): Xaa can be any naturally occurring amino acid
  misc_feature (857)..(857): Xaa can be any naturally occurring amino acid
  misc_feature (857)..(857): Xaa can be any naturally occurring amino acid
MKYXIGLDIGTNSVGWAVTDXYXXKXKGXXXIXKNXGLFDGTARXRTARRRRRXNRIYLQIFXEMDFFRLXSFVXXKXXXPXFXXEYHXXPTIYHLRXLXKDLRLXYLALAHXIKXRGNFLIEGXXNXXXXXXYXFXIXXXXXXXXXPEKGFXXXLXGXFXFXLEXXXKXXYXXXLXLLIGDXYXXXFXAKXXXXLSXXVTXALSXXMIXRXXHDLLKXXYXEXFXKGYAGYIDGXQFYXXKLXXXGXXXKXXXEXXLRKQRTFDNGXIPXQXHLEXAIXXQXYPFLNXXIXXXTFRIPYXVGPLAGXSFAWRKIPWNXXXXDSAFIXXMTDLPXXXVLPKHSLYXXVYNELTKVXXXXXXKXIFKRKVXXXXGXXFNXSTYHDLXXXXXLDXNXXEXIXLTXFEDXMIXXLXXXXKXLRRXYTGWGXLSXLXGIRXXXSTILDXLDNRNXMQLIXDLXFKIKQXXXXXGSPAIKKGILQXXKXVDELVXMGPXIVXEMARENQTXGNSXRKXXKEXGSXILKEXXNLXNXXLXLYYLQNGXDMYXXLDILSXYDXDHIXPQXFXDXSIDNVLSNRKDXVPXXVXKKXWXLXLXXXRKFDLTKAERGGLXDKAFIXRQLVETRQITKXVAXLXXNXDXXXXVXXXTLKSLVSXFRKXFXXLYKVXXNXXHHAHDAYLNVXXLXYPXLEEFVYGDYXXKATKFYXNIMXFXXGEXWKXXXXVXMQXNXVKKEQXXXPKNSXLXKDKYGGXXXXXXKGKXXXXIXXXXXXFLXGYXXXXLPKYXLXXXGXRXLASEXKGNXLXXLXAXXXXXXXXEXXXXFXANXXXXXLXXGXAFXXXIRRYXXXTXIXQSXTGLYEXRL

SEQ ID NO: 15 - protein, 8 aa, Artificial Sequence
  RuvC-like domain
  VARIANT (2)..(2): Xaa is Val or His
  VARIANT (3)..(3): Xaa is Ile, Leu, or Val
  VARIANT (5)..(5): Xaa is Met or Thr
IXXEXARE

SEQ ID NO: 16 - protein, 8 aa, Artificial Sequence
  RuvC-like domain
  VARIANT (3)..(3): Xaa is Ile, Leu, or Val
IVXEMARE

SEQ ID NO: 17 - protein, 8 aa, Artificial Sequence
  RuvC-like domain
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 18 - protein, 8 aa, Artificial Sequence
  RuvC-like domain
HHAHDAYL

SEQ ID NO: 19 - protein, 30 aa, Artificial Sequence
  N-terminal RuvC-like domain
  VARIANT (2)..(2): Xaa is Lys or Pro
  VARIANT (4)..(4): Xaa is Val, Leu, Ile, or Phe
  VARIANT (5)..(5): Xaa is Gly, Ala, or Ser
  VARIANT (6)..(6): Xaa is Leu, Ile, Val, or Phe
  MOD_RES (7)..(26): N-terminal RuvC-like domain, each Xaa can be any amino acid or absent, region may encompass 5-20 residues
  VARIANT (29)..(29): Xaa is Asp, Glu, Asn, or Gln
KXYXXXXXXXXXXXXXXXXXXXXXXXTDXY

SEQ ID NO: 20 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (6)..(6): Xaa is Ser, Tyr, Asn, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXXXGXXXX

SEQ ID NO: 21 - protein, 12 aa, Artificial Sequence
  N-terminal RuvC-like domain
  VARIANT (2)..(2): Xaa is Ile, Val, Met, Leu, or Thr
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (7)..(7): Xaa is Val, Ile, Leu, Cys, Thr, or Phe
  VARIANT (9)..(9): Xaa is Trp, Phe, Val, Tyr, Ser, or Leu
  VARIANT (10)..(10): Xaa is Ala, Ser, Cys, Val, or Gly
  VARIANT (11)..(11): Xaa is Val, Ile, Leu, Ala, Met, or His
  VARIANT (12)..(12): Any amino acid or absent
DXGXXSXGXXXX

SEQ ID NO: 22 - protein, 12 aa, Artificial Sequence
  N-terminal RuvC-like domain
  VARIANT (4)..(4): Xaa is Thr, Ile, Val, Ser, Asn, Tyr, Glu, or Leu
  VARIANT (5)..(5): Xaa is Asn, Ser, Gly, Ala, Asp, Thr, Arg, Met, or Phe
  VARIANT (11)..(11): Xaa is Val, Ile, Leu, Ala, Met, or His
  VARIANT (12)..(12): Any amino acid or absent
DIGXXSVGWAXX

SEQ ID NO: 23 - protein, 12 aa, Artificial Sequence
  N-terminal RuvC-like domain
  MOD_RES (12)..(12): Any non-polar alkyl amino acid or a hydroxyl amino acid
DIGTNSVGWAVX

SEQ ID NO: 24 - protein, 73 aa, Artificial Sequence
  HNH-like domain
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu, Gln, or Asp
  VARIANT (15)..(15): Xaa is Glu or Asp
  VARIANT (19)..(19): Xaa is Asp, Asn, or His
  VARIANT (20)..(20): Xaa is Tyr, Arg, or Asn
  VARIANT (23)..(23): Xaa is Gln, Asp, or Asn
  MOD_RES (25)..(64): HNH-like domain, each Xaa can be any amino acid or absent, region may encompass 15-40 residues
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 25 - protein, 27 aa, Artificial Sequence
  HNH-like domain
  VARIANT (1)..(1): Xaa is Asp, Glu, Gln, or Asn
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (9)..(9): Xaa is Ser, Ala, Asp, Thr, or Lys
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (13)..(13): Xaa is Asp, Ser, Asn, Arg, Leu, or Thr
  VARIANT (14)..(14): Xaa is Asp, Asn, or Ser
  VARIANT (15)..(15): Xaa is Ser, Ala, Thr, Gly, or Arg
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (19)..(19): Xaa is Lys, Leu, Arg, Met, Thr, or Phe
  VARIANT (20)..(20): Xaa is Val, Leu, Ile, Ala, or Thr
  VARIANT (21)..(21): Xaa is Leu, Ile, Val, or Ala
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXXXXXXXXXXNXXXXXXXXN

SEQ ID NO: 26 - protein, 27 aa, Artificial Sequence
  HNH-like domain
  VARIANT (1)..(1): Xaa is Asp or Glu
  VARIANT (2)..(2): Xaa is Leu, Ile, Arg, Gln, Val, Met, or Lys
  VARIANT (3)..(3): Xaa is Asp or Glu
  VARIANT (5)..(5): Xaa is Ile, Val, Thr, Ala, or Leu
  VARIANT (6)..(6): Xaa is Val, Tyr, Ile, Leu, Phe, or Trp
  VARIANT (8)..(8): Xaa is Gln, His, Arg, Lys, Tyr, Ile, Leu, Phe, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (22)..(22): Xaa is Thr, Val, Cys, Glu, Ser, or Ala
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XXXHXXPXSXXXDDSXXNKVLXXXXXN

SEQ ID NO: 27 - protein, 27 aa, Artificial Sequence
  HNH-like domain
  VARIANT (1)..(1): Xaa is Asp or Glu
  VARIANT (3)..(3): Xaa is Asp or Glu
  VARIANT (8)..(8): Xaa is Gln, His, Arg, Lys, Tyr, Ile, Leu, or Trp
  VARIANT (10)..(10): Xaa is Phe, Leu, Val, Lys, Tyr, Met, Ile, Arg, Ala, Glu, Asp, or Gln
  VARIANT (11)..(11): Xaa is Leu, Arg, Thr, Ile, Val, Ser, Cys, Tyr, Lys, Phe, or Gly
  VARIANT (12)..(12): Xaa is Lys, Gln, Tyr, Thr, Phe, Leu, Trp, Met, Ala, Glu, Gly, or Ser
  VARIANT (16)..(16): Xaa is Ile, Leu, Phe, Ser, Arg, Tyr, Gln, Trp, Asp, Lys, or His
  VARIANT (17)..(17): Xaa is Asp, Ser, Ile, Asn, Glu, Ala, His, Phe, Leu, Gln, Met, Gly, Tyr, or Val
  VARIANT (23)..(23): Xaa is Arg, Phe, Thr, Trp, Glu, Leu, Asn, Cys, Lys, Val, Ser, Gln, Ile, Tyr, His, or Ala
  VARIANT (24)..(24): Xaa is Ser, Pro, Arg, Lys, Asn, Ala, His, Gln, Gly, or Leu
  VARIANT (25)..(25): Xaa is Asp, Gly, Thr, Asn, Ser, Lys, Ala, Ile, Glu, Leu, Gln, Arg, or Tyr
  VARIANT (26)..(26): Xaa is Lys, Val, Ala, Glu, Tyr, Ile, Cys, Leu, Ser, Thr, Gly, Lys, Met, Asp, or Phe
XVXHIVPXSXXXDDSXXNKVLTXXXXN

SEQ ID NO: 28 - protein, 27 aa, Artificial Sequence
  HNH-like domain
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg, Lys, or Leu
  VARIANT (22)..(22): Xaa is Thr or Val
  VARIANT (23)..(23): Xaa is Ser or Arg
  VARIANT (25)..(25): Xaa is Lys, Asp, or Ala
  VARIANT (26)..(26): Xaa is Glu, Lys, Gly, or Asn
DXDHIXPQXFXXDXSIDNXVLXXSXXN

SEQ ID NO: 29 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 116 nt, Artificial Sequence
  gRNA
  misc_feature (1)..(20): a, c, u, g, unknown or other
  misc_feature (1)..(20): targeting region
  misc_feature (21)..(42): first complementarity domain
  misc_feature (43)..(46): linking domain
  misc_feature (47)..(70): second complementarity domain
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 31 - RNA, 96 nt, Artificial Sequence
  gRNA
  misc_feature (1)..(20): a, c, u, g, unknown or other
  misc_feature (1)..(20): targeting domain
  misc_feature (21)..(32): first complementarity domain
  misc_feature (33)..(36): linking domain
  misc_feature (37)..(50): second complementarity domain
  misc_feature (51)..(62): proximal domain
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 47 nt, Artificial Sequence
  gRNA proximal and tail domains derived from S. pyogenes
aaggcuaguccguuaucaacuugaaaaaguggcaccgagucggugcu

SEQ ID NO: 33 - RNA, 49 nt, Artificial Sequence
  gRNA proximal and tail domains
aaggcuaguccguuaucaacuugaaaaaguggcaccgagucgguggugc

SEQ ID NO: 34 - RNA, 51 nt, Artificial Sequence
  gRNA proximal and tail domains
aaggcuaguccguuaucaacuugaaaaaguggcaccgagucggugcggauc

SEQ ID NO: 35 - RNA, 31 nt, Artificial Sequence
  gRNA proximal and tail domains
aaggcuaguccguuaucaacuugaaaaagug

SEQ ID NO: 36 - RNA, 18 nt, Artificial Sequence
  gRNA proximal and tail domains
aaggcuaguccguuauca

SEQ ID NO: 37 - RNA, 12 nt, Artificial Sequence
  gRNA proximal and tail domains
aaggcuaguccg

SEQ ID NO: 38 - RNA, 102 nt, Artificial Sequence
  Unimolecular gRNA derived from S. aureus
  misc_feature (1)..(20): n is a, c, g, or u
  misc_feature (1)..(20): Targeting domain
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 39 - RNA, 42 nt, Artificial
  Modular gRNA derived from S. pyogenes
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuaugcuguuuug

SEQ ID NO: 40 - RNA, 85 nt, Artificial Sequence
  Modular gRNA derived from S. pyogenes
  misc_feature (1)..(9): 5' extension domain
  misc_feature (10)..(33): Second complementarity domain
  misc_feature (34)..(45): Proximal domain
  misc_feature (46)..(85): Tail domain
ggaaccauucaaaacagcauagcaaguuaaaauaaggcuaguccguuaucaacuugaaaaaguggcaccgagucggugcuuuuuu

SEQ ID NO: 41 - RNA, 62 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguuuuagagcuagaaauagcaaguuaaaauaaggcuaguccg

SEQ ID NO: 42 - RNA, 102 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
  misc_feature (63)..(102): Tail domain
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 43 - RNA, 75 nt, Artificial Sequence
  Unimolecular gRNA derived from S. pyogenes
  misc_feature (1)..(20): Targeting domain
  misc_feature (1)..(20): a, c, u, g, unknown or other
  misc_feature (21)..(36): First complementarity domain
  misc_feature (37)..(40): Linking domain
  misc_feature (41)..(58): Second complementarity domain
  misc_feature (59)..(70): Proximal domain
  misc_feature (71)..(75): Tail domain
nnnnnnnnnnnnnnnnnnnnguuuuagagcuaugcugaaaagcauagcaaguuaaaauaaggcuaguccguuauc

SEQ ID NO: 44 - RNA, 87 nt, Artificial Sequence
  Unimolecular gRNA derived from S. pyogenes
  misc_feature (1)..(20): a, c, u, g, unknown or other
  misc_feature (1)..(20): Targeting domain
  misc_feature (21)..(32): First complementarity domain
  misc_feature (43)..(46): Linking domain
  misc_feature (57)..(70): Second complementarity domain
  misc_feature (71)..(82): Proximal domain
  misc_feature (83)..(87): Tail domain
nnnnnnnnnnnnnnnnnnnnguuuuagagcuaugcuguuuuggaaacaaaacagcauagcaaguuaaaauaaggcuaguccguuauc

SEQ ID NO: 45 - RNA, 42 nt, Artificial Sequence
  Modular gRNA derived from S. thermophilus
  misc_feature (1)..(20): a, c, u, g, unknown or other
  misc_feature (1)..(20): Targeting domain
  misc_feature (21)..(42): First complementarity domain
nnnnnnnnnnnnnnnnnnnnguuuuagagcuguguuguuucg

SEQ ID NO: 46 - RNA, 78 nt, Artificial Sequence
  Modular gRNA derived from S. thermophilus
  misc_feature (1)..(3): 5' extension domain
  misc_feature (4)..(27): Second complementarity domain
  misc_feature (28)..(40): Proximal domain
  misc_feature (41)..(78): Tail domain
gggcgaaacaacacagcgaguuaaaauaaggcuuaguccguacucaacuugaaaagguggcaccgauucgguguuuuu

SEQ ID NO: 47 - RNA, 85 nt, Artificial Sequence
  Modular gRNA derived from S. pyogenes
gaaccauucaaaacagcauagcaaguuaaaauaaggcuaguccguuaucaacuugaaaaaguggcaccgagucggugcuuuuuuu

SEQ ID NO: 48 - RNA, 96 nt, Artificial Sequence
  gRNA from S. pyogenes
  misc_feature (1)..(20): n is a, c, g, or u
  misc_feature (1)..(20): Targeting domain
nnnnnnnnnnnnnnnnnnnnguuuuagagcuagaaauagcaaguuaaaauaaggcuaguccguuaucaacuugaaaaaguggcaccgagucggugc

SEQ ID NO: 49 - RNA, 96 nt, Artificial Sequence
  gRNA
  misc_feature (1)..(20): n is a, c, g, or u
  misc_feature (1)..(20): Targeting domain
  misc_feature (21)..(32): First complementarity domain
  misc_feature (33)..(36): Linking domain
  misc_feature (37)..(50): Second complementarity domain
  misc_feature (51)..(62): Proximal domain
nnnnnnnnnnnnnnnnnnnnguauuagagcuagaaauagcaaguuaauauaaggcuaguccguuaucaacuugaaaaaguggcaccgagucggugc

SEQ ID NO: 50 - RNA, 104 nt, Artificial Sequence
  gRNA
  misc_feature (1)..(20): n is a, c, g, or u
  misc_feature (1)..(20): Targeting domain
  misc_feature (21)..(36): First complementarity domain
  misc_feature (37)..(40): Linking domain
  misc_feature (41)..(58): Second complementarity domain
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 51 - RNA, 106 nt, Artificial Sequence
  gRNA
  misc_feature (1)..(20): n is a, c, g, or u
  misc_feature (1)..(20): Targeting domain
  misc_feature (21)..(37): First complementarity domain
  misc_feature (38)..(41): Linking domain
  misc_feature (42)..(60): Second complementarity domain
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 52 - protein, 12 aa, Peptoniphilus duerdenii
DIGTASVGWAVT

SEQ ID NO: 53 - protein, 12 aa, Treponema denticola
DVGTGSVGWAVT

SEQ ID NO: 54 - protein, 12 aa, S. mutans
DIGTNSVGWAVV

SEQ ID NO: 55 - protein, 12 aa, S. pyogenes
DIGTNSVGWAVI

SEQ ID NO: 56 - protein, 12 aa, L. innocua
DIGTNSVGWAVL

SEQ ID NO: 57 - protein, 12 aa, Flavobacterium branchiophilum FL-15
DLGTNSIGWAVV

SEQ ID NO: 58 - protein, 11 aa, Pedobacter glucosidilyticus
DLGTNSIGWAI

SEQ ID NO: 59 - protein, 12 aa, Bacteroides fragilis, NCTC 9343
DLGTNSIGWALV

SEQ ID NO: 60 - protein, 12 aa, Fusobacterium nucleatum
DIGTNSVGWCVT

SEQ ID NO: 61 - protein, 12 aa, Acidaminococcus sp. D21
DIGTNSVGYAVT

SEQ ID NO: 62 - protein, 12 aa, Coprococcus catus GD-7
DMGTGSLGWAVT

SEQ ID NO: 63 - protein, 12 aa, Oenococcus kitaharae DSM 17330
DIGTSSVGWAAI

SEQ ID NO: 64 - protein, 12 aa, Catenibacterium mitsuokai DSM 15897
DLGTGSVGWAVV

SEQ ID NO: 65 - protein, 12 aa, Mycoplasma gallisepticum str. F
DLGVGSVGWAIV

SEQ ID NO: 66 - protein, 12 aa, Mycoplasma ovipneumoniae SC01
DLGIASIGWAII

SEQ ID NO: 67 - protein, 12 aa, Mycoplasma canis PG 14
DLGIASVGWAIV

SEQ ID NO: 68 - protein, 12 aa, Mycoplasma synoviae 53
DLGVASVGWSIV

SEQ ID NO: 69 - protein, 12 aa, Eubacterium rectale
DIGIASVGWAIL

SEQ ID NO: 70 - protein, 12 aa, Enterococcus faecalis TX0012
DLGISSVGWSVI

SEQ ID NO: 71 - protein, 12 aa, Ilyobacter polytropus DSM 2926
DIGIASVGWSVI

SEQ ID NO: 72 - protein, 12 aa, Ruminococcus albus 8
DVGIGSIGWAVI

SEQ ID NO: 73 - protein, 12 aa, Elusimicrobium minutum Pei191
DLGVGSIGFAIV

SEQ ID NO: 74 - protein, 12 aa, Akkermansia muciniphila
DIGYASIGWAVI

SEQ ID NO: 75 - protein, 12 aa, Prevotella ruminicola
DTGTNSLGWAIV

SEQ ID NO: 76 - protein, 12 aa, Cand. Puniceispirillum marinum
DLGTNSIGWCLL

SEQ ID NO: 77 - protein, 12 aa, Rhodospirillum rubrum
DIGTDSLGWAVF

SEQ ID NO: 78 - protein, 12 aa, Lactobacillus rhamnosus GG
DIGSNSIGFAVV

SEQ ID NO: 79 - protein, 12 aa, Sphaerochaeta globus str. Buddy
DLGVGSIGVAVA

SEQ ID NO: 80 - protein, 12 aa, Rhodopseudomonas palustris
DLGIASCGWGVV

SEQ ID NO: 81 - protein, 12 aa, Mycoplasma mobile 163K
DLGIASVGWCLT

SEQ ID NO: 82 - protein, 12 aa, Streptococcus thermophilus LMD-9
DIGIGSVGVGIL

SEQ ID NO: 83 - protein, 12 aa, Staphylococcus lugdunensis M23590
DIGITSVGYGLI

SEQ ID NO: 84 - protein, 12 aa, Eubacterium dolichum DSM 3991
DIGITSVGFGII

SEQ ID NO: 85 - protein, 12 aa, Lactobacillus coryniformis KCTC 3535
DVGITSTGYAVL

SEQ ID NO: 86 - protein, 12 aa, Nitratifractor salsuginis DSM 16511
DLGITSFGYAIL

SEQ ID NO: 87 - protein, 12 aa, Bifidobacterium bifidum S17
DIGNASVGWSAF

SEQ ID NO: 88 - protein, 12 aa, Lactobacillus gasseri
DVGTNSCGWVAM

SEQ ID NO: 89 - protein, 12 aa, Acidothermus cellulolyticus 11B
DVGERSIGLAAV

SEQ ID NO: 90 - protein, 12 aa, Bifidobacterium longum DJO10A
DVGLNSVGLAAV

SEQ ID NO: 91 - protein, 12 aa, Bifidobacterium dentium
DVGLMSVGLAAI

SEQ ID NO: 92 - protein, 12 aa, Corynebacterium diphtheriae
DVGTFSVGLAAI

SEQ ID NO: 93 - protein, 12 aa, Staphylococcus pseudintermedius ED99
DIGTGSVGYACM

SEQ ID NO: 94 - protein, 12 aa, Capnocytophaga ochracea
DLGTTSIGFAHI

SEQ ID NO: 95 - protein, 12 aa, Prevotella denticola
DLGTNSIGSSVR

SEQ ID NO: 96 - protein, 12 aa, Ralstonia solanacearum
DIGTNSIGWAVI

SEQ ID NO: 97 - protein, 12 aa, Pasteurella multocida str. Pm70
DLGIASVGWAVV

SEQ ID NO: 98 - protein, 12 aa, Comamonas granuli
DIGIASVGWAVL

SEQ ID NO: 99 - protein, 12 aa, Helicobacter mustelae 12198
DIGIASIGWAVI

SEQ ID NO: 100 - protein, 12 aa, Agathobacter rectalis
DIGIASVGWAII

SEQ ID NO: 101 - protein, 12 aa, Clostridium cellulolyticum H10
DVGIASVGWAVI

SEQ ID NO: 102 - protein, 11 aa, Methylophilus sp. OH31
DIGIASVGWAL

SEQ ID NO: 103 - protein, 12 aa, Neisseria meningitidis
DIGIASVGWAMV

SEQ ID NO: 104 - protein, 12 aa, Clostridium perfringens
DIGITSVGWAVI

SEQ ID NO: 105 - protein, 12 aa, Wolinella succinogenes DSM 1740
DLGISSLGWAIV

SEQ ID NO: 106 - protein, 12 aa, Azospirillum sp. B510
DLGTNSIGWGLL

SEQ ID NO: 107 - protein, 12 aa, Verminephrobacter eiseniae
DLGSTSLGWAIF

SEQ ID NO: 108 - protein, 12 aa, Campylobacter jejuni, NCTC 11168
DIGISSIGWAFS

SEQ ID NO: 109 - protein, 12 aa, Parvibaculum lavamentivorans DS-1
DIGTTSIGFSVI

SEQ ID NO: 110 - protein, 12 aa, Dinoroseobacter shibae DFL 12
DIGTSSIGWWLY

SEQ ID NO: 111 - protein, 12 aa, Nitrobacter hamburgensis X14
DLGSNSLGWFVT

SEQ ID NO: 112 - protein, 12 aa, Bradyrhizobium sp. BTAi1
DLGANSLGWFVV

SEQ ID NO: 113 - protein, 15 aa, Bacillus cereus
DIGLRIGITSCGWSI

SEQ ID NO: 114 - protein, 12 aa, Sutterella wadsworthensis
DMGAKYTGVFYA

SEQ ID NO: 115 - protein, 12 aa, Wolinella succinogenes DSM 1740
DLGGKNTGFFSF

SEQ ID NO: 116 - protein, 12 aa, Francisella tularensis
DLGVKNTGVFSA

SEQ ID NO: 117 - protein, 12 aa, Gamma proteobacterium HTCC5015
DLGAKFTGVALY

SEQ ID NO: 118 - protein, 12 aa, Legionella pneumophila str. Paris
DLGGKFTGVCLS

SEQ ID NO: 119 - protein, 12 aa, Parasutterella excrementihominis
DLGGTYTGTFIT

SEQ ID NO: 120 - protein, 12 aa, S. thermophilus
DIGTNSVGWAVT

SEQ ID NO: 121 - protein, 12 aa, Eubacterium yurii
DVGTNSVGWAVT

SEQ ID NO: 122 - protein, 12 aa, Butyrivibrio hungatei
DMGTNSVGWAVT

SEQ ID NO: 123 - protein, 12 aa, Solobacterium moorei F0204
DVGTSSVGWAVT

SEQ ID NO: 124 - protein, 27 aa, Treponema denticola
DIDHIYPQSKIKDDSISNRVLVCSSCN

SEQ ID NO: 125 - protein, 27 aa, Coprococcus catus GD-7
DIDHIYPQSKTMDDSLNNRVLVKKNYN

SEQ ID NO: 126 - protein, 27 aa, Peptoniphilus duerdenii
DQDHIYPKSKIYDDSLENRVLVKKNLN

SEQ ID NO: 127 - protein, 27 aa, Catenibacterium mitsuokai DSM 15897
QIDHIVPQSLVKDDSFDNRVLVVPSEN

SEQ ID NO: 128 - protein, 27 aa, S. mutans
DIDHIIPQAFIKDNSIDNRVLTSSKEN

SEQ ID NO: 129 - protein, 27 aa, S. thermophilus
DIDHIIPQAFLKDNSIDNKVLVSSASN

SEQ ID NO: 130 - protein, 27 aa, Oenococcus kitaharae DSM 17330
DIDHIIPQAYTKDNSLDNRVLVSNITN

SEQ ID NO: 131 - protein, 27 aa, L. inocua
DIDHIVPQSFITDNSIDNLVLTSSAGN

SEQ ID NO: 132 - protein, 27 aa, S. pyogenes
DVDHIVPQSFLKDDSIDNKVLTRSDKN

SEQ ID NO: 133 - protein, 27 aa, Acidaminococcus sp. D21
NIDHIYPQSMVKDDSLDNKVLVQSEIN

SEQ ID NO: 134 - protein, 27 aa, Lactobacillus rhamnosus GG
DIDHILPQSLIKDDSLDNRVLVNATIN

SEQ ID NO: 135 - protein, 27 aa, Lactobacillus gasseri
DIDHILPQSFIKDDSLENRVLVKKAVN

SEQ ID NO: 136 - protein, 27 aa, Staphylococcus pseudintermedius ED99
EVDHIFPRSFIKDDSIDNKVLVIKKMN

SEQ ID NO: 137 - protein, 27 aa, Olsenella uli
EVDHIIPRSYIKDDSFENKVLVYREEN

SEQ ID NO: 138 - protein, 27 aa, Bifidobacterium bifidum S17
DIDHIIPQAVTQNDSIDNRVLVARAEN

SEQ ID NO: 139 - protein, 27 aa, Mycoplasma gallisepticum str. F
EIDHIIPYSISFDDSSSNKLLVLAESN

SEQ ID NO: 140 - protein, 27 aa, Mycoplasma canis PG 14
EIDHIIPYSLCFDDSSANKVLVHKQSN

SEQ ID NO: 141 - protein, 27 aa, Ilyobacter polytropus DSM 2926
DIDHIIPYSRSMDDSYSNKVLVLSGEN

SEQ ID NO: 142 - protein, 27 aa, Uncultured Termite group 1 bacterium
DIDHIIPYSKSMDDSFNNKVLCLAEEN

SEQ ID NO: 143 - protein, 27 aa, Campylobacter jejuni
EIDHIYPYSRSFDDSYMNKVLVFTKQN

SEQ ID NO: 144 - protein, 27 aa, Clostridium cellulolyticum H10
QIDHIYPYSRSMDDSYMNKVLVLTDEN

SEQ ID NO: 145 - protein, 27 aa, Clostridium perfringens
EIDHIIPFSRSFDDSLSNKILVLGSEN

SEQ ID NO: 146 - protein, 27 aa, N. meningitides
EIDHALPFSRTWDDSFNNKVLVLGSEN

SEQ ID NO: 147 - protein, 27 aa, Pasteurella multocida str. Pm70
EIDHALPFSRTWDDSFNNKVLVLASEN

SEQ ID NO: 148 - protein, 27 aa, Enterococcus faecalis TX0012
EIDHIIPISISLDDSINNKVLVLSKAN

SEQ ID NO: 149 - protein, 27 aa, Eubacterium dolichum DSM 3991
EVDHIIPISISLDDSITNKVLVTHREN

SEQ ID NO: 150 - protein, 27 aa, Acidovorax ebreus
QVDHALPYSRSYDDSKNNKVLVLTHEN

SEQ ID NO: 151 - protein, 27 aa, Streptococcus thermophilus LMD-9
EVDHILPLSITFDDSLANKVLVYATAN

SEQ ID NO: 152 - protein, 27 aa, Eubacterium rectale
EIDHIIPRSISFDDARSNKVLVYRSEN

SEQ ID NO: 153 - protein, 27 aa, Staphylococcus lugdunensis M23590
EVDHIIPRSVSFDNSYHNKVLVKQSEN

SEQ ID NO: 154 - protein, 27 aa, Roseburia intestinalis
DIDHILPYSITFDDSFRNKVLVTSQEN

SEQ ID NO: 155 - protein, 27 aa, Wolinella succinogenes DSM 1740
EIDHILPRSRSADDSFANKVLCLARAN

SEQ ID NO: 156 - protein, 27 aa, Cand. Puniceispirillum marinum
EIEHLLPFSLTLDDSMANKTVCFRQAN

SEQ ID NO: 157 - protein, 27 aa, Azospirillum sp. B510
DIDHILPFSVSLDDSAANKVVCLREAN

SEQ ID NO: 158 - protein, 27 aa, Bradyrhizobium sp. BTAi1
DIDHLIPFSISWDDSAANKVVCMRYAN

SEQ ID NO: 159 - protein, 27 aa, Nitrobacter hamburgensis X14
DIDHILPVAMTLDDSPANKIICMRYAN

SEQ ID NO: 160 - protein, 27 aa, Dinoroseobacter shibae
DVDHILPYSRTLDDSFPNRTLCLREAN

SEQ ID NO: 161 - protein, 27 aa, Verminephrobacter eiseniae
EIEHILPFSRTLDDSLNNRTVAMRRAN

SEQ ID NO: 162 - protein, 27 aa, Lactobacillus coryniformis KCTC 3535
EVDHIIPYSISWDDSYTNKVLTSAKCN

SEQ ID NO: 163 - protein, 27 aa, Rhodopseudomonas palustris
QVDHILPWSRFGDDSYLNKTLCTARSN

SEQ ID NO: 164 - protein, 27 aa, Ralstonia syzygii R24
QVDHILPFSKTLDDSFANKVLAQHDAN

SEQ ID NO: 165 - protein, 27 aa, Helicobacter mustelae 12198
QIDHAFPLSRSLDDSQSNKVLCLTSSN

SEQ ID NO: 166 - protein, 27 aa, Mycoplasma mobile 163K
DIDHIVPRSISFDDSFSNLVIVNKLDN

SEQ ID NO: 167 - protein, 27 aa, Mycoplasma ovipneumoniae SC01
EIEHIIPYSMSYDNSQANKILTEKAEN

SEQ ID NO: 168 - protein, 27 aa, Mycoplasma synoviae 53
EIDHVIPYSKSADDSWFNKLLVKKSTN

SEQ ID NO: 169 - protein, 27 aa, Aminomonas paucivorans DSM 12260
EMDHILPYSRSLDNGWHNRVLVHGKDN

SEQ ID NO: 170 - protein, 27 aa, Ruminococcus albus 8
EVDHIVPYSLILDNTINNKALVYAEEN

SEQ ID NO: 171 - protein, 27 aa, Fibrobacter succinogenes
EIEHVIPQSLYFDDSFSNKVICEAEVN

SEQ ID NO: 172 - protein, 27 aa, Bacteroides fragilis, NCTC 9343
DIEHIIPQARLFDDSFSNKTLEARSVN

SEQ ID NO: 173 - protein, 27 aa, Capnocytophaga sputigena
EIEHIVPKARVFDDSFSNKTLTFHRIN

SEQ ID NO: 174 - protein, 28 aa, Finegoldia magna
DKDHIIPQSMKKDDSIINNLVLVNKNAN

SEQ ID NO: 175 - protein, 27 aa, Parvibaculum lavamentivorans DS-1
EVEHIWPRSRSFDNSPRNKTLCRKDVN

SEQ ID NO: 176 - protein, 27 aa, Bacillus cereus
IVNHIIPYNRSFDDTYHNRVLTLTETK

SEQ ID NO: 177 - protein, 27 aa, Prevotella micans
DMEHTIPKSISFDNSDQNLTLCESYYN

SEQ ID NO: 178 - protein, 27 aa, Prevotella ruminicola
DIEHTIPRSAGGDSTKMNLTLCSSRFN

SEQ ID NO: 179 - protein, 27 aa, Flavobacterium columnare
DIEHTIPRSISQDNSQMNKTLCSLKFN

SEQ ID NO: 180 - protein, 27 aa, Rhodospirillum rubrum
DIDHVIPLARGGRDSLDNMVLCQSDAN

SEQ ID NO: 181 - protein, 27 aa, Elusimicrobium minutum Pei191
DIEHLFPIAESEDNGRNNLVISHSACN

SEQ ID NO: 182 - protein, 27 aa, Sphaerochaeta globus str. Buddy
DVDHIFPRDDTADNSYGNKVVAHRQCN

SEQ ID NO: 183 - protein, 27 aa, Nitratifractor salsuginis DSM 16511
DIEHIVPQSLGGLSTDYNTIVTLKSVN

SEQ ID NO: 184 - protein, 27 aa, Acidothermus cellulolyticus 11B
ELDHIVPRTDGGSNRHENLAITCGACN

SEQ ID NO: 185 - protein, 28 aa, Bifidobacterium longum DJO10A
EMDHIVPRKGVGSTNTRTNFAAVCAECN

SEQ ID NO: 186 - protein, 28 aa, Bifidobacterium dentium
EMDHIVPRKGVGSTNTRVNLAAACAACN

SEQ ID NO: 187 - protein, 28 aa, Corynebacterium diphtheriae
EMDHIVPRAGQGSTNTRENLVAVCHRCN

SEQ ID NO: 188 - protein, 33 aa, Sutterella wadsworthensis
EIDHILPRSLIKDARGIVFNAEPNLIYASSRGN

SEQ ID NO: 189 - protein, 33 aa, Gamma proteobacterium HTCC5015
EIDHIIPRSLTGRTKKTVFNSEANLIYCSSKGN

SEQ ID NO: 190 - protein, 33 aa, Parasutterella excrementihominis
EIDHIIPRSLTLKKSESIYNSEVNLIFVSAQGN

SEQ ID NO: 191 - protein, 33 aa, Legionella pneumophila str. Paris
EIDHIYPRSLSKKHFGVIFNSEVNLIYCSSQGN

SEQ ID NO: 192 - protein, 33 aa, Wolinella succinogenes DSM 1740
EIDHILPRSHTLKIYGTVFNPEGNLIYVHQKCN

SEQ ID NO: 193 - protein, 30 aa, Francisella tularensis
ELDHIIPRSHKKYGTLNDEANLICVTRGDN

SEQ ID NO: 194 - protein, 27 aa, Akkermansia muciniphila
ELEHIVPHSFRQSNALSSLVLTWPGVN

SEQ ID NO: 195 - protein, 27 aa, Solobacterium moorei F0204
DIDHIYPRSKIKDDSITNRVLVEKDIN

SEQ ID NO: 196 - protein, 28 aa, Veillonella atypica ACS-134-V-Col7a
YDIDHIYPRSLTKDDSFDNLVLCERTAN

SEQ ID NO: 197 - protein, 28 aa, Fusobacterium nucleatum
DIDHIYPRSKVIKDDSFDNLVLVLKNEN

SEQ ID NO: 198 - protein, 27 aa, Filifactor alocis
DRDHIYPQSKIKDDSIDNLVLVNKTYN

SEQ ID NO: 199 - DNA, 5 bp, Streptococcus thermophilus
  misc_feature (1)..(1): Any nucleotide (e.g., A, G, C, or T)
  misc_feature (4)..(4): Any nucleotide (e.g., A, G, C, or T)
nggng

SEQ ID NO: 200 - DNA, 7 bp, Streptococcus thermophilus
  misc_feature (1)..(1): Any nucleotide (e.g., A, G, C, or T)
  misc_feature (2)..(2): Any nucleotide (e.g., A, G, C, or T)
  misc_feature (7)..(7): A or T
nnagaaw

SEQ ID NO: 201 - DNA, 4 bp, Streptococcus mutans
  misc_feature (1)..(1): Any nucleotide (e.g., A, G, C, or T)
  misc_feature (4)..(4): A or G
naar

SEQ ID NO: 202 - DNA, 5 bp, Staphylococcus aureus
  misc_feature (1)..(1): Any nucleotide (e.g., A, G, C, or T)
  misc_feature (2)..(2): Any nucleotide (e.g., A, G, C, or T)
  misc_feature (4)..(4): A or G
  misc_feature (5)..(5): A or G
nngrr

SEQ ID NO: 203 - DNA, 6 bp, Staphylococcus aureus
  misc_feature (1)..(1): Any nucleotide (e.g., A, G, C, or T)
  misc_feature (2)..(2): Any nucleotide (e.g., A, G, C, or T)
  misc_feature (4)..(4): A or G
  misc_feature (5)..(5): A or G
  misc_feature (6)..(6): Any nucleotide (e.g., A, G, C, or T)
nngrrn

SEQ ID NO: 204 - DNA, 6 bp, Staphylococcus aureus
  misc_feature (1)..(1): Any nucleotide (e.g., A, G, C, or T)
  misc_feature (2)..(2): Any nucleotide (e.g., A, G, C, or T)
  misc_feature (4)..(4): A or G
  misc_feature (5)..(5): A or G
nngrrt

SEQ ID NO: 205 - DNA, 6 bp, Staphylococcus aureus
  misc_feature (1)..(1): Any nucleotide (e.g., A, G, C, or T)
  misc_feature (2)..(2): Any nucleotide (e.g., A, G, C, or T)
  misc_feature (4)..(4): A or G
  misc_feature (5)..(5): A or G
  misc_feature (6)..(6): A, G, or C
nngrrv

SEQ ID NO: 206-250 - skipped (45 entries)

SEQ ID NO: 251 - RNA, 17 nt, Artificial Sequence
  Targeting domain
gaaggaaacuagcuaaa

SEQ ID NO: 252 - RNA, 20 nt, Artificial Sequence
  Targeting domain
ggagaaggaaacuagcuaaa

SEQ ID NO: 253 - RNA, 20 nt, Artificial Sequence
  Targeting domain
gggagaaggaaacuagcuaa

SEQ ID NO: 254 - RNA, 20 nt, Artificial Sequence
  Targeting domain
guauccucuaugaugggaga

SEQ ID NO: 255 - RNA, 20 nt, Artificial Sequence
  Targeting domain
guuuccuucucccaucauag

SEQ ID NO: 256 - RNA, 20 nt, Artificial Sequence
  Targeting domain
guccugguauccucuaugau

SEQ ID NO: 257 - RNA, 17 nt, Artificial Sequence
  Targeting domain
agaaggaaacuagcuaa

SEQ ID NO: 258 - RNA, 17 nt, Artificial Sequence
  Targeting domain
uccucuaugaugggaga

SEQ ID NO: 259 - RNA, 17 nt, Artificial Sequence
  Targeting domain
ccugguauccucuauga

SEQ ID NO: 260 - RNA, 17 nt, Artificial Sequence
  Targeting domain
ccaucauagaggauacc

SEQ ID NO: 261 - RNA, 17 nt, Artificial Sequence
  Targeting domain
uccuucucccaucauag

SEQ ID NO: 262 - RNA, 17 nt, Artificial Sequence
  Targeting domain
uagcaguauccucuugg

SEQ ID NO: 263 - RNA, 17 nt, Artificial Sequence
  Targeting domain
uuagcaguauccucuug

SEQ ID NO: 264 - RNA, 17 nt, Artificial Sequence
  Targeting domain
aacuggaaugacugaau

SEQ ID NO: 265 - RNA, 17 nt, Artificial Sequence
  Targeting domain
cugguauccucuaugau

SEQ ID NO: 266 - RNA, 17 nt, Artificial Sequence
  Targeting domain
aauuagcaguauccucu

SEQ ID NO: 267 - RNA, 17 nt, Artificial Sequence
  Targeting domain
auuagcaguauccucuu

SEQ ID NO: 268 - RNA, 20 nt, Artificial Sequence
  Targeting domain
aguccugguauccucuauga

SEQ ID NO: 269 - RNA, 20 nt, Artificial Sequence
  Targeting domain
cucccaucauagaggauacc

SEQ ID NO: 270 - RNA, 20 nt, Artificial Sequence
  Targeting domain
aauuagcaguauccucuugg

SEQ ID NO: 271 - RNA, 20 nt, Artificial Sequence
  Targeting domain
aaauuagcaguauccucuug

SEQ ID NO: 272 - RNA, 20 nt, Artificial Sequence
  Targeting domain
aaaaacuggaaugacugaau

SEQ ID NO: 273 - RNA, 20 nt, Artificial Sequence
  Targeting domain
aaaaauuagcaguauccucu

SEQ ID NO: 274 - RNA, 20 nt, Artificial Sequence
  Targeting domain
aaaauuagcaguauccucuu

SEQ ID NO: 275 - RNA, 17 nt, Artificial Sequence
  Targeting domain
gaaucggaacaaggcaa

SEQ ID NO: 276 - RNA, 17 nt, Artificial Sequence
  Targeting domain
gaccaauagccuugaca

SEQ ID NO: 277 - RNA, 17 nt, Artificial Sequence
  Targeting domain
ggcuauuggucaaggca

SEQ ID NO: 278 - RNA, 17 nt, Artificial Sequence
  Targeting domain
gucaaggcuauugguca

SEQ ID NO: 279 - RNA, 17 nt, Artificial Sequence
  Targeting domain
guguguggaacugcuga

SEQ ID NO: 280 - RNA, 17 nt, Artificial Sequence
  Targeting domain
gggccggcggcuggcua

SEQ ID NO: 281 - RNA, 17 nt, Artificial Sequence
  Targeting domain
gaguauccagugaggcc

SEQ ID NO: 282 - RNA, 17 nt, Artificial Sequence
  Targeting domain
gcugacaaaagaagucc

SEQ ID NO: 283 - RNA, 17 nt, Artificial Sequence
  Targeting domain
ggccaggggccggcggc

SEQ ID NO: 284 - RNA, 17 nt, Artificial Sequence
  Targeting domain
gggaaggggcccccaag

SEQ ID NO: 285 - RNA, 17 nt, Artificial Sequence
  Targeting domain
gagauaguguggggaag

SEQ ID NO: 286 - RNA, 17 nt, Artificial Sequence
  Targeting domain
guauccagugaggccag

SEQ ID NO: 287 - RNA, 17 nt, Artificial Sequence
  Targeting domain
gugaggccaggggccgg

SEQ ID NO: 288 - RNA, 17 nt, Artificial Sequence
  Targeting domain
gcuggccaacccauggg

SEQ ID NO: 289 - RNA, 17 nt, Artificial Sequence
  Targeting domain
ggcuaaacuccacccau

SEQ ID NO: 290 - RNA, 17 nt, Artificial Sequence
  Targeting domain
ggauacucuaagacuau

SEQ ID NO: 291 - RNA, 17 nt, Artificial Sequence
  Targeting domain
ggggccggcggcuggcu

SEQ ID NO: 292 - RNA, 20 nt, Artificial Sequence
  Targeting domain
ggcuagggaugaagaauaaa

SEQ ID NO: 293 - RNA, 20 nt, Artificial Sequence
  Targeting domain
gaguguguggaacugcugaa

SEQ ID NO: 294 - RNA, 20 nt, Artificial Sequence
  Targeting domain
ggaaugacugaaucggaaca

SEQ ID NO: 295 - RNA, 20 nt, Artificial Sequence
  Targeting domain
gcauugagauagugugggga

SEQ ID NO: 296 - RNA, 20 nt, Artificial Sequence
  Targeting domain
gcuauuggucaaggcaaggc

SEQ ID NO: 297 - RNA, 20 nt, Artificial Sequence
  Targeting domain
guggggaaggggcccccaag

SEQ ID NO: 298 - RNA, 20 nt, Artificial Sequence
  Targeting domain
ggcaaggcuggccaacccau

SEQ ID NO: 299 - RNA, 20 nt, Artificial Sequence
  Targeting domain
guuugccuugucaaggcuau

SEQ ID NO: 300 - RNA, 20 nt, Artificial Sequence
  Targeting domain
gcuaaacuccacccaugggu

SEQ ID NO: 301 - RNA, 17 nt, Artificial Sequence
  Targeting domain
caaauaucugucugaaa

SEQ ID NO: 302 - RNA, 17 nt, Artificial Sequence
  Targeting domain
uagggaugaagaauaaa

SEQ ID NO: 303 - RNA, 17 nt, Artificial Sequence
  Targeting domain
ugagauaguguggggaa

SEQ ID NO: 304 - RNA, 17 nt, Artificial Sequence
  Targeting domain
uguguggaacugcugaa

SEQ ID NO: 305 - RNA, 17 nt, Artificial Sequence
  Targeting domain
augacugaaucggaaca

SEQ ID NO: 306 - RNA, 17 nt, Artificial Sequence
  Targeting domain
caaggcuggccaaccca

SEQ ID NO: 307 - RNA, 17 nt, Artificial Sequence
  Targeting domain
uggcuaaacuccaccca

SEQ ID NO: 308 - RNA, 17 nt, Artificial Sequence
  Targeting domain
uggguggaguuuagcca

SEQ ID NO: 309 - RNA, 17 nt, Artificial Sequence
  Targeting domain
aguauccagugaggcca

SEQ ID NO: 310 - RNA, 17 nt, Artificial Sequence
  Targeting domain
ucaaguuugccuuguca

SEQ ID NO: 311 - RNA, 17 nt, Artificial Sequence
  Targeting domain
uugagauagugugggga

SEQ ID NO: 312 - RNA, 17 nt, Artificial Sequence
  Targeting domain
auaaauuagagaaaaac

SEQ ID NO: 313 - RNA, 17 nt, Artificial Sequence
  Targeting domain
ccggccccuggccucac

SEQ ID NO: 314 - RNA, 17 nt, Artificial Sequence
  Targeting domain
agccagccgccggcccc

SEQ ID NO: 315 - RNA, 17 nt, Artificial Sequence
  Targeting domain
cugucugaaacgguccc

SEQ ID NO: 316 - RNA, 17 nt, Artificial Sequence
  Targeting domain
auggguggaguuuagcc

SEQ ID NO: 317 - RNA, 17 nt, Artificial Sequence
  Targeting domain
caucccuagccagccgc

SEQ ID NO: 318 - RNA, 17 nt, Artificial Sequence
  Targeting domain
auuggucaaggcaaggc

SEQ ID NO: 319 - RNA, 17 nt, Artificial Sequence
  Targeting domain
ccagugaggccaggggc

SEQ ID NO: 320 - RNA, 17 nt, Artificial Sequence
  Targeting domain
uuccacacacucgcuuc

SEQ ID NO: 321 - RNA, 17 nt, Artificial Sequence
  Targeting domain
cgcuucuggaacgucug

SEQ ID NO: 322 - RNA, 17 nt, Artificial Sequence
  Targeting domain
ucuuagaguauccagug

SEQ ID NO: 323 - RNA, 17 nt, Artificial Sequence
  Targeting domain
uuugcauugagauagug

SEQ ID NO: 324 - RNA, 17 nt, Artificial Sequence
  Targeting domain
uuccagaagcgagugug

SEQ ID NO: 325 - RNA, 17 nt, Artificial Sequence
  Targeting domain
ugcauugagauagugug

SEQ ID NO: 326 - RNA, 17 nt, Artificial Sequence
  Targeting domain
aaggcuggccaacccau

SEQ ID NO: 327 - RNA, 17 nt, Artificial Sequence
  Targeting domain
ugccuugucaaggcuau

SEQ ID NO: 328 - RNA, 17 nt, Artificial Sequence
  Targeting domain
aaacuccacccaugggu

SEQ ID NO: 329 - RNA, 17 nt, Artificial Sequence
  Targeting domain
uugcauugagauagugu

SEQ ID NO: 330 - RNA, 20 nt, Artificial Sequence
  Targeting domain
augcaaauaucugucugaaa

SEQ ID NO: 331 - RNA, 20 nt, Artificial Sequence
  Targeting domain
acugaaucggaacaaggcaa

SEQ ID NO: 332 - RNA, 20 nt, Artificial Sequence
  Targeting domain
cauugagauaguguggggaa

SEQ ID NO: 333 - RNA, 20 nt, Artificial Sequence
  Targeting domain
cuugaccaauagccuugaca

SEQ ID NO: 334 - RNA, 20 nt, Artificial Sequence
  Targeting domain
aggcaaggcuggccaaccca

SEQ ID NO: 335 - RNA, 20 nt, Artificial Sequence
  Targeting domain
cccuggcuaaacuccaccca

SEQ ID NO: 336 - RNA, 20 nt, Artificial Sequence
  Targeting domain
ccauggguggaguuuagcca

SEQ ID NO: 337 - RNA, 20 nt, Artificial Sequence
  Targeting domain
uagaguauccagugaggcca

SEQ ID NO: 338 - RNA, 20 nt, Artificial Sequence
  Targeting domain
caaggcuauuggucaaggca

SEQ ID NO: 339 - RNA, 20 nt, Artificial Sequence
  Targeting domain
cuugucaaggcuauugguca

SEQ ID NO: 340 - RNA, 20 nt, Artificial Sequence
  Targeting domain
uggucaaguuugccuuguca

SEQ ID NO: 341 - RNA, 20 nt, Artificial Sequence
  Targeting domain
cgaguguguggaacugcuga

SEQ ID NO: 342 - RNA, 20 nt, Artificial Sequence
  Targeting domain
caggggccggcggcuggcua

SEQ ID NO: 343 - RNA, 20 nt, Artificial Sequence
  Targeting domain
agaauaaauuagagaaaaac

SEQ ID NO: 344 - RNA, 20 nt, Artificial Sequence
  Targeting domain
ccgccggccccuggccucac

SEQ ID NO: 345 - RNA, 20 nt, Artificial Sequence
  Targeting domain
ccuagccagccgccggcccc

SEQ ID NO: 346 - RNA, 20 nt, Artificial Sequence
  Targeting domain
uaucugucugaaacgguccc

SEQ ID NO: 347 - RNA, 20 nt, Artificial Sequence
  Targeting domain
cccauggguggaguuuagcc

SEQ ID NO: 348 - RNA, 20 nt, Artificial Sequence
  Targeting domain
uuagaguauccagugaggcc

SEQ ID NO: 349 - RNA, 20 nt, Artificial Sequence
  Targeting domain
acggcugacaaaagaagucc

SEQ ID NO: 350 - RNA, 20 nt, Artificial Sequence
  Targeting domain
cuucaucccuagccagccgc

SEQ ID NO: 351 - RNA, 20 nt, Artificial Sequence
  Targeting domain
ugaggccaggggccggcggc

SEQ ID NO: 352 - RNA, 20 nt, Artificial Sequence
  Targeting domain
uauccagugaggccaggggc

SEQ ID NO: 353 - RNA, 20 nt, Artificial Sequence
  Targeting domain
caguuccacacacucgcuuc

SEQ ID NO: 354 - RNA, 20 nt, Artificial Sequence
  Targeting domain
auugagauaguguggggaag

SEQ ID NO: 355 - RNA, 20 nt, Artificial Sequence
  Targeting domain
agaguauccagugaggccag

SEQ ID NO: 356 - RNA, 20 nt, Artificial Sequence
  Targeting domain
ccagugaggccaggggccgg

SEQ ID NO: 357 - RNA, 20 nt, Artificial Sequence
  Targeting domain
aaggcuggccaacccauggg

SEQ ID NO: 358 - RNA, 20 nt, Artificial Sequence
  Targeting domain
acucgcuucuggaacgucug

SEQ ID NO: 359 - RNA, 20 nt, Artificial Sequence
  Targeting domain
uagucuuagaguauccagug

SEQ ID NO: 360 - RNA, 20 nt, Artificial Sequence
  Targeting domain
auauuugcauugagauagug

SEQ ID NO: 361 - RNA, 20 nt, Artificial Sequence
  Targeting domain
acguuccagaagcgagugug

SEQ ID NO: 362 - RNA, 20 nt, Artificial Sequence
  Targeting domain
auuugcauugagauagugug

SEQ ID NO: 363 - RNA, 20 nt, Artificial Sequence
  Targeting domain
ccuggcuaaacuccacccau

SEQ ID NO: 364 - RNA, 20 nt, Artificial Sequence
  Targeting domain
acuggauacucuaagacuau

SEQ ID NO: 365 - RNA, 20 nt, Artificial Sequence
  Targeting domain
ccaggggccggcggcuggcu

SEQ ID NO: 366 - RNA, 20 nt, Artificial Sequence
  Targeting domain
uauuugcauugagauagugu

SEQ ID NO: 367 - RNA, 19 nt, Artificial Sequence
  Targeting domain
guuuccuucucccaucaua

SEQ ID NO: 368 - RNA, 23 nt, Artificial Sequence
  Targeting domain
gcuaguuuccuucucccaucaua

SEQ ID NO: 369 - RNA, 19 nt, Artificial Sequence
  Targeting domain
gaauaaauuagagaaaaac

SEQ ID NO: 370 - RNA, 22 nt, Artificial Sequence
  Targeting domain
gaagaauaaauuagagaaaaac

SEQ ID NO: 371 - RNA, 23 nt, Artificial Sequence
  Targeting domain
ggaagaauaaauuagagaaaaac

SEQ ID NO: 372 - RNA, 24 nt, Artificial Sequence
  Targeting domain
gggaagaauaaauuagagaaaaac

SEQ ID NO: 373 - RNA, 20 nt, Artificial Sequence
  Targeting domain
gaaggaaacuagcuaaaggg

SEQ ID NO: 374 - RNA, 22 nt, Artificial Sequence
  Targeting domain
gagaaggaaacuagcuaaaggg

SEQ ID NO: 375 - RNA, 23 nt, Artificial Sequence
  Targeting domain
ggagaaggaaacuagcuaaaggg

SEQ ID NO: 376 - RNA, 24 nt, Artificial Sequence
  Targeting domain
gggagaaggaaacuagcuaaaggg

SEQ ID NO: 377 - RNA, 18 nt, Artificial Sequence
  Targeting domain
uuuccuucucccaucaua

SEQ ID NO: 378 - RNA, 20 nt, Artificial Sequence
  Targeting domain
aguuuccuucucccaucaua

SEQ ID NO: 379 - RNA, 21 nt, Artificial Sequence
  Targeting domain
uaguuuccuucucccaucaua

SEQ ID NO: 380 - RNA, 22 nt, Artificial Sequence
  Targeting domain
cuaguuuccuucucccaucaua

SEQ ID NO: 381 - RNA, 24 nt, Artificial Sequence
  Targeting domain
agcuaguuuccuucucccaucaua

SEQ ID NO: 382 - RNA, 18 nt, Artificial Sequence
  Targeting domain
agagaaaaacuggaauga

SEQ ID NO: 383 - RNA, 19 nt, Artificial Sequence
  Targeting domain
uagagaaaaacuggaauga

SEQ ID NO: 384 - RNA, 20 nt, Artificial Sequence
  Targeting domain
uuagagaaaaacuggaauga

SEQ ID NO: 385 - RNA, 21 nt, Artificial Sequence
  Targeting domain
auuagagaaaaacuggaauga

SEQ ID NO: 386 - RNA, 22 nt, Artificial Sequence
  Targeting domain
aauuagagaaaaacuggaauga

SEQ ID NO: 387 - RNA, 23 nt, Artificial Sequence
  Targeting domain
aaauuagagaaaaacuggaauga

SEQ ID NO: 388 - RNA, 24 nt, Artificial Sequence
  Targeting domain
uaaauuagagaaaaacuggaauga

SEQ ID NO: 389 - RNA, 18 nt, Artificial Sequence
  Targeting domain
aauaaauuagagaaaaac

SEQ ID NO: 390 - RNA, 21 nt, Artificial Sequence
  Targeting domain
aagaauaaauuagagaaaaac

SEQ ID NO: 391 - RNA, 18 nt, Artificial Sequence
  Targeting domain
aggaaacuagcuaaaggg

SEQ ID NO: 392 - RNA, 19 nt, Artificial Sequence
  Targeting domain
aaggaaacuagcuaaaggg

SEQ ID NO: 393 - RNA, 21 nt, Artificial Sequence
  Targeting domain
agaaggaaacuagcuaaaggg

SEQ ID NO: 394 - RNA, 18 nt, Artificial Sequence
  Targeting domain
uggggaaggggcccccaa

SEQ ID NO: 395 - RNA, 19 nt, Artificial Sequence
  Targeting domain
guggggaaggggcccccaa

SEQ ID NO: 396 - RNA, 20 nt, Artificial Sequence
  Targeting domain
uguggggaaggggcccccaa

SEQ ID NO: 397 - RNA, 21 nt, Artificial Sequence
  Targeting domain
guguggggaaggggcccccaa

SEQ ID NO: 398 - RNA, 22 nt, Artificial Sequence
  Targeting domain
aguguggggaaggggcccccaa

SEQ ID NO: 399 - RNA, 23 nt, Artificial Sequence
  Targeting domain
uaguguggggaaggggcccccaa

SEQ ID NO: 400 - RNA, 24 nt, Artificial Sequence
  Targeting domain
auaguguggggaaggggcccccaa

SEQ ID NO: 401 - RNA, 18 nt, Artificial Sequence
  Targeting domain
accucagacguuccagaa

SEQ ID NO: 402 - RNA, 19 nt, Artificial Sequence
  Targeting domain
aaccucagacguuccagaa

SEQ ID NO: 403 - RNA, 20 nt, Artificial Sequence
  Targeting domain
uaaccucagacguuccagaa

SEQ ID NO: 404 - RNA, 21 nt, Artificial Sequence
  Targeting domain
auaaccucagacguuccagaa

SEQ ID NO: 405 - RNA, 22 nt, Artificial Sequence
  Targeting domain
gauaaccucagacguuccagaa

SEQ ID NO: 406 - RNA, 23 nt, Artificial Sequence
  Targeting domain
ugauaaccucagacguuccagaa

SEQ ID NO: 407 - RNA, 24 nt, Artificial Sequence
  Targeting domain
uugauaaccucagacguuccagaa

SEQ ID NO: 408 - RNA, 18 nt, Artificial Sequence
  Targeting domain
cgccggccccuggccuca

SEQ ID NO: 409 - RNA, 19 nt, Artificial Sequence
  Targeting domain
ccgccggccccuggccuca

SEQ ID NO: 410 - RNA, 20 nt, Artificial Sequence
  Targeting domain
gccgccggccccuggccuca

SEQ ID NO: 411 - RNA, 21 nt, Artificial Sequence
  Targeting domain
agccgccggccccuggccuca

SEQ ID NO: 412 - RNA, 22 nt, Artificial Sequence
  Targeting domain
cagccgccggccccuggccuca

SEQ ID NO: 413 - RNA, 23 nt, Artificial Sequence
  Targeting domain
ccagccgccggccccuggccuca

SEQ ID NO: 414 - RNA, 24 nt, Artificial Sequence
  Targeting domain
gccagccgccggccccuggccuca

SEQ ID NO: 415 - RNA, 18 nt, Artificial Sequence
  Targeting domain
ggcaaggcuggccaaccc

SEQ ID NO: 416 - RNA, 19 nt, Artificial Sequence
  Targeting domain
aggcaaggcuggccaaccc

SEQ ID NO: 417 - RNA, 20 nt, Artificial Sequence
  Targeting domain
aaggcaaggcuggccaaccc

SEQ ID NO: 418 - RNA, 21 nt, Artificial Sequence
  Targeting domain
caaggcaaggcuggccaaccc

SEQ ID NO: 419 - RNA, 22 nt, Artificial Sequence
  Targeting domain
ucaaggcaaggcuggccaaccc

SEQ ID NO: 420 - RNA, 23 nt, Artificial Sequence
  Targeting domain
gucaaggcaaggcuggccaaccc

SEQ ID NO: 421 - RNA, 24 nt, Artificial Sequence
  Targeting domain
ggucaaggcaaggcuggccaaccc

SEQ ID NO: 422 - RNA, 18 nt, Artificial Sequence
  Targeting domain
ggcuggccaacccauggg

SEQ ID NO: 423 - RNA, 19 nt, Artificial Sequence
  Targeting domain
aggcuggccaacccauggg

SEQ ID NO: 424 - RNA, 21 nt, Artificial Sequence
  Targeting domain
caaggcuggccaacccauggg

SEQ ID NO: 425 - RNA, 22 nt, Artificial Sequence
  Targeting domain
gcaaggcuggccaacccauggg

SEQ ID NO: 426 - RNA, 23 nt, Artificial Sequence
  Targeting domain
ggcaaggcuggccaacccauggg

SEQ ID NO: 427 - RNA, 24 nt, Artificial Sequence
  Targeting domain
aggcaaggcuggccaacccauggg

SEQ ID NO: 428 - RNA, 18 nt, Artificial Sequence
  Targeting domain
gaguguguggaacugcug

SEQ ID NO: 429 - RNA, 19 nt, Artificial Sequence
  Targeting domain
cgaguguguggaacugcug

SEQ ID NO: 430 - RNA, 20 nt, Artificial Sequence
  Targeting domain
gcgaguguguggaacugcug

SEQ ID NO: 431 - RNA, 21 nt, Artificial Sequence
  Targeting domain
agcgaguguguggaacugcug

SEQ ID NO: 432 - RNA, 22 nt, Artificial Sequence
  Targeting domain
aagcgaguguguggaacugcug

SEQ ID NO: 433 - RNA, 23 nt, Artificial Sequence
  Targeting domain
gaagcgaguguguggaacugcug

SEQ ID NO: 434 - RNA, 24 nt, Artificial Sequence
  Targeting domain
agaagcgaguguguggaacugcug

SEQ ID NO: 435 - RNA, 18 nt, Artificial Sequence
  Targeting domain
ccuggcuaaacuccaccc

SEQ ID NO: 436 - RNA, 19 nt, Artificial Sequence
  Targeting domain
cccuggcuaaacuccaccc

SEQ ID NO: 437 - RNA, 20 nt, Artificial Sequence
  Targeting domain
ucccuggcuaaacuccaccc

SEQ ID NO: 438 - RNA, 21 nt, Artificial Sequence
  Targeting domain
gucccuggcuaaacuccaccc

SEQ ID NO: 439 - RNA, 22 nt, Artificial Sequence
  Targeting domain
ggucccuggcuaaacuccaccc

SEQ ID NO: 440 - RNA, 23 nt, Artificial Sequence
  Targeting domain
cggucccuggcuaaacuccaccc

SEQ ID NO: 441 - RNA, 24 nt, Artificial Sequence
  Targeting domain
acggucccuggcuaaacuccaccc

SEQ ID NO: 442 - RNA, 18 nt, Artificial Sequence
  Targeting domain
ggcggcuggcuagggaug

SEQ ID NO: 443 - RNA, 19 nt, Artificial Sequence
  Targeting domain
cggcggcuggcuagggaug

SEQ ID NO: 444 - RNA, 20 nt, Artificial Sequence
  Targeting domain
ccggcggcuggcuagggaug

SEQ ID NO: 445 - RNA, 21 nt, Artificial Sequence
  Targeting domain
gccggcggcuggcuagggaug

SEQ ID NO: 446 - RNA, 22 nt, Artificial Sequence
  Targeting domain
ggccggcggcuggcuagggaug

SEQ ID NO: 447 - RNA, 23 nt, Artificial Sequence
  Targeting domain
gggccggcggcuggcuagggaug

SEQ ID NO: 448 - RNA, 24 nt, Artificial Sequence
  Targeting domain
ggggccggcggcuggcuagggaug

SEQ ID NO: 449 - RNA, 18 nt, Artificial Sequence
  Targeting domain
aggggccggcggcuggcu

SEQ ID NO: 450 - RNA, 19 nt, Artificial Sequence
  Targeting domain
caggggccggcggcuggcu

SEQ ID NO: 451 - RNA, 21 nt, Artificial Sequence
  Targeting domain
gccaggggccggcggcuggcu

SEQ ID NO: 452 - RNA, 22 nt, Artificial Sequence
  Targeting domain
ggccaggggccggcggcuggcu

SEQ ID NO: 453 - RNA, 23 nt, Artificial Sequence
  Targeting domain
aggccaggggccggcggcuggcu

SEQ ID NO: 454 - RNA, 24 nt, Artificial Sequence
  Targeting domain
gaggccaggggccggcggcuggcu

SEQ ID NO: 455 - RNA, 18 nt, Artificial Sequence
  Targeting domain
aaacuugaccaauagucu

SEQ ID NO: 456 - RNA, 19 nt, Artificial Sequence
  Targeting domain
caaacuugaccaauagucu

SEQ ID NO: 457 - RNA, 20 nt, Artificial Sequence
  Targeting domain
gcaaacuugaccaauagucu

SEQ ID NO: 458 - RNA, 21 nt, Artificial Sequence
  Targeting domain
ggcaaacuugaccaauagucu

SEQ ID NO: 459 - RNA, 22 nt, Artificial Sequence
  Targeting domain
aggcaaacuugaccaauagucu

SEQ ID NO: 460 - RNA, 23 nt, Artificial Sequence
  Targeting domain
aaggcaaacuugaccaauagucu

SEQ ID NO: 461 - RNA, 24 nt, Artificial Sequence
  Targeting domain
caaggcaaacuugaccaauagucu

SEQ ID NO: 462 - RNA, 18 nt, Artificial Sequence
  Targeting domain
uucagacagauauuugca

SEQ ID NO: 463 - RNA, 19 nt, Artificial Sequence
  Targeting domain
uuucagacagauauuugca

SEQ ID NO: 464 - RNA, 20 nt, Artificial Sequence
  Targeting domain
guuucagacagauauuugca

SEQ ID NO: 465 - RNA, 21 nt, Artificial Sequence
  Targeting domain
cguuucagacagauauuugca

SEQ ID NO: 466 - RNA, 22 nt, Artificial Sequence
  Targeting domain
ccguuucagacagauauuugca

SEQ ID NO: 467 - RNA, 23 nt, Artificial Sequence
  Targeting domain
accguuucagacagauauuugca

SEQ ID NO: 468 - RNA, 24 nt, Artificial Sequence
  Targeting domain
gaccguuucagacagauauuugca

SEQ ID NO: 469 - RNA, 18 nt, Artificial Sequence
  Targeting domain
aguuuccuucucccauca

SEQ ID NO: 470 - RNA, 19 nt, Artificial Sequence
  Targeting domain
uaguuuccuucucccauca

SEQ ID NO: 471 - RNA, 20 nt, Artificial Sequence
  Targeting domain
cuaguuuccuucucccauca

SEQ ID NO: 472 - RNA, 21 nt, Artificial Sequence
  Targeting domain
gcuaguuuccuucucccauca

SEQ ID NO: 473 - RNA, 22 nt, Artificial Sequence
  Targeting domain
agcuaguuuccuucucccauca

SEQ ID NO: 474 - RNA, 23 nt, Artificial Sequence
  Targeting domain
uagcuaguuuccuucucccauca

SEQ ID NO: 475 - RNA, 24 nt, Artificial Sequence
  Targeting domain
uuagcuaguuuccuucucccauca

SEQ ID NO: 476 - RNA, 18 nt, Artificial Sequence
  Targeting domain
auugagauagugugggga

SEQ ID NO: 477 - RNA, 19 nt, Artificial Sequence
  Targeting domain
cauugagauagugugggga

SEQ ID NO: 478 - RNA, 21 nt, Artificial Sequence
  Targeting domain
ugcauugagauagugugggga

SEQ ID NO: 479 - RNA, 22 nt, Artificial Sequence
  Targeting domain
uugcauugagauagugugggga

SEQ ID NO: 480 - RNA, 23 nt, Artificial Sequence
  Targeting domain
uuugcauugagauagugugggga

SEQ ID NO: 481 - RNA, 24 nt, Artificial Sequence
  Targeting domain
auuugcauugagauagugugggga

SEQ ID NO: 482 - RNA, 18 nt, Artificial Sequence
  Targeting domain
ucccaucauagaggauac

SEQ ID NO: 483 - RNA, 19 nt, Artificial Sequence
  Targeting domain
cucccaucauagaggauac

SEQ ID NO: 484 - RNA, 20 nt, Artificial Sequence
  Targeting domain
ucucccaucauagaggauac

SEQ ID NO: 485 - RNA, 21 nt, Artificial Sequence
  Targeting domain
uucucccaucauagaggauac

SEQ ID NO: 486 - RNA, 22 nt, Artificial Sequence
  Targeting domain
cuucucccaucauagaggauac

SEQ ID NO: 487 - RNA, 23 nt, Artificial Sequence
  Targeting domain
ccuucucccaucauagaggauac

SEQ ID NO: 488 - RNA, 24 nt, Artificial Sequence
  Targeting domain
uccuucucccaucauagaggauac

SEQ ID NO: 489 - RNA, 18 nt, Artificial Sequence
  Targeting domain
uguggggaaggggccccc

SEQ ID NO: 490 - RNA, 19 nt, Artificial Sequence
  Targeting domain
guguggggaaggggccccc

SEQ ID NO: 491 - RNA, 20 nt, Artificial Sequence
  Targeting domain
aguguggggaaggggccccc

SEQ ID NO: 492 - RNA, 21 nt, Artificial Sequence
  Targeting domain
uaguguggggaaggggccccc

SEQ ID NO: 493 - RNA, 22 nt, Artificial Sequence
  Targeting domain
auaguguggggaaggggccccc

SEQ ID NO: 494 - RNA, 23 nt, Artificial Sequence
  Targeting domain
gauaguguggggaaggggccccc

SEQ ID NO: 495 - RNA, 24 nt, Artificial Sequence
  Targeting domain
agauaguguggggaaggggccccc

SEQ ID NO: 496 - RNA, 18 nt, Artificial Sequence
  Targeting domain
cauggguggaguuuagcc

SEQ ID NO: 497 - RNA, 19 nt, Artificial Sequence
  Targeting domain
ccauggguggaguuuagcc

SEQ ID NO: 498 - RNA, 21 nt, Artificial Sequence
  Targeting domain
acccauggguggaguuuagcc

SEQ ID NO: 499 - RNA, 22 nt, Artificial Sequence
  Targeting domain
aacccauggguggaguuuagcc

SEQ ID NO: 500 - RNA, 23 nt, Artificial Sequence
  Targeting domain
caacccauggguggaguuuagcc

SEQ ID NO: 501 - RNA, 24 nt, Artificial Sequence
  Targeting domain
ccaacccauggguggaguuuagcc

SEQ ID NO: 502 - RNA, 18 nt, Artificial Sequence
  Targeting domain
ccauggguggaguuuagc

SEQ ID NO: 503 - RNA, 19 nt, Artificial Sequence
  Targeting domain
cccauggguggaguuuagc

SEQ ID NO: 504 - RNA, 20 nt, Artificial Sequence
  Targeting domain
acccauggguggaguuuagc

SEQ ID NO: 505 - RNA, 21 nt, Artificial Sequence
  Targeting domain
aacccauggguggaguuuagc

SEQ ID NO: 506 - RNA, 22 nt, Artificial Sequence
  Targeting domain
caacccauggguggaguuuagc

SEQ ID NO: 507 - RNA, 23 nt, Artificial Sequence
  Targeting domain
ccaacccauggguggaguuuagc

SEQ ID NO: 508 - RNA, 24 nt, Artificial Sequence
  Targeting domain
gccaacccauggguggaguuuagc

SEQ ID NO: 509 - RNA, 18 nt, Artificial Sequence
  Targeting domain
ugauaaccucagacguuc

SEQ ID NO: 510 - RNA, 19 nt, Artificial Sequence
  Targeting domain
uugauaaccucagacguuc

SEQ ID NO: 511 - RNA, 20 nt, Artificial Sequence
  Targeting domain
auugauaaccucagacguuc

SEQ ID NO: 512 - RNA, 21 nt, Artificial Sequence
  Targeting domain
uauugauaaccucagacguuc

SEQ ID NO: 513 - RNA, 22 nt, Artificial Sequence
  Targeting domain
uuauugauaaccucagacguuc

SEQ ID NO: 514 - RNA, 23 nt, Artificial Sequence
  Targeting domain
cuuauugauaaccucagacguuc

SEQ ID NO: 515 - RNA, 24 nt, Artificial Sequence
  Targeting domain
gcuuauugauaaccucagacguuc

SEQ ID NO: 516 - RNA, 18 nt, Artificial Sequence
  Targeting domain
cauugagauagugugggg

SEQ ID NO: 517 - RNA, 19 nt, Artificial Sequence
  Targeting domain
gcauugagauagugugggg

SEQ ID NO: 518 - RNA, 20 nt, Artificial Sequence
  Targeting domain
ugcauugagauagugugggg

SEQ ID NO: 519 - RNA, 21 nt, Artificial Sequence
  Targeting domain
uugcauugagauagugugggg

SEQ ID NO: 520 - RNA, 22 nt, Artificial Sequence
  Targeting domain
uuugcauugagauagugugggg

SEQ ID NO: 521 - RNA, 23 nt, Artificial Sequence
  Targeting domain
auuugcauugagauagugugggg

SEQ ID NO: 522 - RNA, 24 nt, Artificial Sequence
  Targeting domain
uauuugcauugagauagugugggg

SEQ ID NO: 523 - RNA, 18 nt, Artificial Sequence
  Targeting domain
aggcuggccaacccaugg

SEQ ID NO: 524 - RNA, 19 nt, Artificial Sequence
  Targeting domain
aaggcuggccaacccaugg

SEQ ID NO: 525 - RNA, 20 nt, Artificial Sequence
  Targeting domain
caaggcuggccaacccaugg

SEQ ID NO: 526 - RNA, 21 nt, Artificial Sequence
  Targeting domain
gcaaggcuggccaacccaugg

SEQ ID NO: 527 - RNA, 22 nt, Artificial Sequence
  Targeting domain
ggcaaggcuggccaacccaugg

SEQ ID NO: 528 - RNA, 23 nt, Artificial Sequence
  Targeting domain
aggcaaggcuggccaacccaugg

SEQ ID NO: 529 - RNA, 24 nt, Artificial Sequence
  Targeting domain
aaggcaaggcuggccaacccaugg

SEQ ID NO: 530 - RNA, 18 nt, Artificial Sequence
  Targeting domain
agcgaguguguggaacug

SEQ ID NO: 531 - RNA, 19 nt, Artificial Sequence
  Targeting domain
aagcgaguguguggaacug

SEQ ID NO: 532 - RNA, 20 nt, Artificial Sequence
  Targeting domain
gaagcgaguguguggaacug

SEQ ID NO: 533 - RNA, 21 nt, Artificial Sequence
  Targeting domain
agaagcgaguguguggaacug

SEQ ID NO: 534 - RNA, 22 nt, Artificial Sequence
  Targeting domain
cagaagcgaguguguggaacug

SEQ ID NO: 535 - RNA, 23 nt, Artificial Sequence
  Targeting domain
ccagaagcgaguguguggaacug

SEQ ID NO: 536 - RNA, 24 nt, Artificial Sequence
  Targeting domain
uccagaagcgaguguguggaacug

SEQ ID NO: 537 - RNA, 18 nt, Artificial Sequence
  Targeting domain
auuugcauugagauagug

SEQ ID NO: 538 - RNA, 19 nt, Artificial Sequence
  Targeting domain
uauuugcauugagauagug

SEQ ID NO: 539 - RNA, 21 nt, Artificial Sequence
  Targeting domain
gauauuugcauugagauagug

SEQ ID NO: 540 - RNA, 22 nt, Artificial Sequence
  Targeting domain
agauauuugcauugagauagug

SEQ ID NO: 541 - RNA, 23 nt, Artificial Sequence
  Targeting domain
cagauauuugcauugagauagug

SEQ ID NO: 542 - RNA, 24 nt, Artificial Sequence
  Targeting domain
acagauauuugcauugagauagug

SEQ ID NO: 543 - RNA, 18 nt, Artificial Sequence
  Targeting domain
guuccagaagcgagugug

SEQ ID NO: 544 - RNA, 19 nt, Artificial Sequence
  Targeting domain
cguuccagaagcgagugug

SEQ ID NO: 545 - RNA, 21 nt, Artificial Sequence
  Targeting domain
gacguuccagaagcgagugug

SEQ ID NO: 546 - RNA, 22 nt, Artificial Sequence
  Targeting domain
agacguuccagaagcgagugug

SEQ ID NO: 547 - RNA, 23 nt, Artificial Sequence
  Targeting domain
cagacguuccagaagcgagugug

SEQ ID NO: 548 - RNA, 24 nt, Artificial Sequence
  Targeting domain
ucagacguuccagaagcgagugug

SEQ ID NO: 549 - RNA, 18 nt, Artificial Sequence
  Targeting domain
uugcauugagauagugug

SEQ ID NO: 550 - RNA, 19 nt, Artificial Sequence
  Targeting domain
uuugcauugagauagugug

SEQ ID NO: 551 - RNA, 21 nt, Artificial Sequence
  Targeting domain
uauuugcauugagauagugug

SEQ ID NO: 552 - RNA, 22 nt, Artificial Sequence
  Targeting domain
auauuugcauugagauagugug

SEQ ID NO: 553 - RNA, 23 nt, Artificial Sequence
  Targeting domain
gauauuugcauugagauagugug

SEQ ID NO: 554 - RNA, 24 nt, Artificial Sequence
  Targeting domain
agauauuugcauugagauagugug

SEQ ID NO: 555 - RNA, 18 nt, Artificial Sequence
  Targeting domain
uauuugcauugagauagu

SEQ ID NO: 556 - RNA, 19 nt, Artificial Sequence
  Targeting domain
auauuugcauugagauagu

SEQ ID NO: 557 - RNA, 20 nt, Artificial Sequence
  Targeting domain
gauauuugcauugagauagu

SEQ ID NO: 558 - RNA, 21 nt, Artificial Sequence
  Targeting domain
agauauuugcauugagauagu

SEQ ID NO: 559 - RNA, 22 nt, Artificial Sequence
  Targeting domain
cagauauuugcauugagauagu

SEQ ID NO: 560 - RNA, 23 nt, Artificial Sequence
  Targeting domain
acagauauuugcauugagauagu

SEQ ID NO: 561 - RNA, 24 nt, Artificial Sequence
  Targeting domain
gacagauauuugcauugagauagu

SEQ ID NO: 562 - RNA, 18 nt, Artificial Sequence
  Targeting domain
cguuccagaagcgagugu

SEQ ID NO: 563 - RNA, 19 nt, Artificial Sequence
  Targeting domain
acguuccagaagcgagugu

SEQ ID NO: 564 - RNA, 20 nt, Artificial Sequence
  Targeting domain
gacguuccagaagcgagugu

SEQ ID NO: 565 - RNA, 21 nt, Artificial Sequence
  Targeting domain
agacguuccagaagcgagugu

SEQ ID NO: 566 - RNA, 22 nt, Artificial Sequence
  Targeting domain
cagacguuccagaagcgagugu

SEQ ID NO: 567 - RNA, 23 nt, Artificial Sequence
  Targeting domain
ucagacguuccagaagcgagugu

SEQ ID NO: 568 - RNA, 24 nt, Artificial Sequence
  Targeting domain
cucagacguuccagaagcgagugu

SEQ ID NO: 569 - RNA, 18 nt, Artificial Sequence
  Targeting domain
uuugcauugagauagugu

SEQ ID NO: 570 - RNA, 19 nt, Artificial Sequence
  Targeting domain
auuugcauugagauagugu

SEQ ID NO: 571 - RNA, 21 nt, Artificial Sequence
  Targeting domain
auauuugcauugagauagugu

SEQ ID NO: 572 - RNA, 22 nt, Artificial Sequence
  Targeting domain
gauauuugcauugagauagugu

SEQ ID NO: 573 - RNA, 23 nt, Artificial Sequence
  Targeting domain
agauauuugcauugagauagugu

SEQ ID NO: 574 - RNA, 24 nt, Artificial Sequence
  Targeting domain
cagauauuugcauugagauagugu

SEQ ID NO: 575 - RNA, 18 nt, Artificial Sequence
  Targeting domain
gaauaaauuagagaaaaa

SEQ ID NO: 576 - RNA, 19 nt, Artificial Sequence
  Targeting domain
agaauaaauuagagaaaaa

SEQ ID NO: 577 - RNA, 20 nt, Artificial Sequence
  Targeting domain
aagaauaaauuagagaaaaa

SEQ ID NO: 578 - RNA, 21 nt, Artificial Sequence
  Targeting domain
gaagaauaaauuagagaaaaa

SEQ ID NO: 579 - RNA, 22 nt, Artificial Sequence
  Targeting domain
ggaagaauaaauuagagaaaaa

SEQ ID NO: 580 - RNA, 23 nt, Artificial Sequence
  Targeting domain
gggaagaauaaauuagagaaaaa

SEQ ID NO: 581 - RNA, 24 nt, Artificial Sequence
  Targeting domain
agggaagaauaaauuagagaaaaa

SEQ ID NO: 582 - RNA, 18 nt, Artificial Sequence
  Targeting domain
cuagggaugaagaauaaa

SEQ ID NO: 583 - RNA, 19 nt, Artificial Sequence
  Targeting domain
gcuagggaugaagaauaaa

SEQ ID NO: 584 - RNA, 21 nt, Artificial Sequence
  Targeting domain
uggcuagggaugaagaauaaa

SEQ ID NO: 585 - RNA, 22 nt, Artificial Sequence
  Targeting domain
cuggcuagggaugaagaauaaa

SEQ ID NO: 586 - RNA, 23 nt, Artificial Sequence
  Targeting domain
gcuggcuagggaugaagaauaaa

SEQ ID NO: 587 - RNA, 24 nt, Artificial Sequence
  Targeting domain
ggcuggcuagggaugaagaauaaa

SEQ ID NO: 588 - RNA, 18 nt, Artificial Sequence
  Targeting domain
agaaggaaacuagcuaaa

SEQ ID NO: 589 - RNA, 19 nt, Artificial Sequence
  Targeting domain
gagaaggaaacuagcuaaa

SEQ ID NO: 590 - RNA, 21 nt, Artificial Sequence
  Targeting domain
gggagaaggaaacuagcuaaa

SEQ ID NO: 591 - RNA, 22 nt, Artificial Sequence
  Targeting domain
ugggagaaggaaacuagcuaaa

SEQ ID NO: 592 - RNA, 23 nt, Artificial Sequence
  Targeting domain
augggagaaggaaacuagcuaaa

SEQ ID NO: 593 - RNA, 24 nt, Artificial Sequence
  Targeting domain
gaugggagaaggaaacuagcuaaa

SEQ ID NO: 594 - RNA, 18 nt, Artificial Sequence
  Targeting domain
aaaacuggaaugacugaa

SEQ ID NO: 595 - RNA, 19 nt, Artificial Sequence
  Targeting domain
aaaaacuggaaugacugaa

SEQ ID NO: 596 - RNA, 20 nt, Artificial Sequence
  Targeting domain
gaaaaacuggaaugacugaa

SEQ ID NO: 597 - RNA, 21 nt, Artificial Sequence
  Targeting domain
agaaaaacuggaaugacugaa

SEQ ID NO: 598 - RNA, 22 nt, Artificial Sequence
  Targeting domain
gagaaaaacuggaaugacugaa

SEQ ID NO: 599 - RNA, 23 nt, Artificial Sequence
  Targeting domain
agagaaaaacuggaaugacugaa

SEQ ID NO: 600 - RNA, 24 nt, Artificial Sequence
  Targeting domain
uagagaaaaacuggaaugacugaa

SEQ ID NO: 601 - RNA, 18 nt, Artificial Sequence
  Targeting domain
gcuagggaugaagaauaa

SEQ ID NO: 602 - RNA, 19 nt, Artificial Sequence
  Targeting domain
ggcuagggaugaagaauaa

SEQ ID NO: 603 - RNA, 20 nt, Artificial Sequence
  Targeting domain
uggcuagggaugaagaauaa

SEQ ID NO: 604 - RNA, 21 nt, Artificial Sequence
  Targeting domain
cuggcuagggaugaagaauaa

SEQ ID NO: 605 - RNA, 22 nt, Artificial Sequence
  Targeting domain
gcuggcuagggaugaagaauaa

SEQ ID NO: 606 - RNA, 23 nt, Artificial Sequence
  Targeting domain
ggcuggcuagggaugaagaauaa

SEQ ID NO: 607 - RNA, 24 nt, Artificial Sequence
  Targeting domain
cggcuggcuagggaugaagaauaa

SEQ ID NO: 608 - RNA, 18 nt, Artificial Sequence
  Targeting domain
gagaaggaaacuagcuaa

SEQ ID NO: 609 - RNA, 19 nt, Artificial Sequence
  Targeting domain
ggagaaggaaacuagcuaa

SEQ ID NO: 610 - RNA, 21 nt, Artificial Sequence
  Targeting domain
ugggagaaggaaacuagcuaa

SEQ ID NO: 611 - RNA, 22 nt, Artificial Sequence
  Targeting domain
augggagaaggaaacuagcuaa

SEQ ID NO: 612 - RNA, 23 nt, Artificial Sequence
  Targeting domain
gaugggagaaggaaacuagcuaa

SEQ ID NO: 613 - RNA, 24 nt, Artificial Sequence
  Targeting domain
ugaugggagaaggaaacuagcuaa

SEQ ID NO: 614 - RNA, 18 nt, Artificial Sequence
  Targeting domain
auagucuuagaguaucca

SEQ ID NO: 615 - RNA, 19 nt, Artificial Sequence
  Targeting domain
aauagucuuagaguaucca

SEQ ID NO: 616 - RNA, 20 nt, Artificial Sequence
  Targeting domain
caauagucuuagaguaucca

SEQ ID NO: 617 - RNA, 21 nt, Artificial Sequence
  Targeting domain
ccaauagucuuagaguaucca

SEQ ID NO: 618 - RNA, 22 nt, Artificial Sequence
  Targeting domain
accaauagucuuagaguaucca

SEQ ID NO: 619 - RNA, 23 nt, Artificial Sequence
  Targeting domain
gaccaauagucuuagaguaucca

SEQ ID NO: 620 - RNA, 24 nt, Artificial Sequence
  Targeting domain
ugaccaauagucuuagaguaucca

SEQ ID NO: 621 - RNA, 18 nt, Artificial Sequence
  Targeting domain
auccucuaugaugggaga

SEQ ID NO: 622 - RNA, 19 nt, Artificial Sequence
  Targeting domain
uauccucuaugaugggaga

SEQ ID NO: 623 - RNA, 21 nt, Artificial Sequence
  Targeting domain
gguauccucuaugaugggaga

SEQ ID NO: 624 - RNA, 22 nt, Artificial Sequence
  Targeting domain
ugguauccucuaugaugggaga

SEQ ID NO: 625 - RNA, 23 nt, Artificial Sequence
  Targeting domain
cugguauccucuaugaugggaga

SEQ ID NO: 626 - RNA, 24 nt, Artificial Sequence
  Targeting domain
ccugguauccucuaugaugggaga

SEQ ID NO: 627 - RNA, 18 nt, Artificial Sequence
  Targeting domain
uccugguauccucuauga

SEQ ID NO: 628 - RNA, 19 nt, Artificial Sequence
  Targeting domain
guccugguauccucuauga

SEQ ID NO: 629 - RNA, 21 nt, Artificial Sequence
  Targeting domain
aaguccugguauccucuauga

SEQ ID NO: 630 - RNA, 22 nt, Artificial Sequence
  Targeting domain
gaaguccugguauccucuauga

SEQ ID NO: 631 - RNA, 23 nt, Artificial Sequence
  Targeting domain
agaaguccugguauccucuauga

SEQ ID NO: 632 - RNA, 24 nt, Artificial Sequence
  Targeting domain
aagaaguccugguauccucuauga

SEQ ID NO: 633 - RNA, 18 nt, Artificial Sequence
  Targeting domain
ggagaaggaaacuagcua

SEQ ID NO: 634 - RNA, 19 nt, Artificial Sequence
  Targeting domain
gggagaaggaaacuagcua

SEQ ID NO: 635 - RNA, 20 nt, Artificial Sequence
  Targeting domain
ugggagaaggaaacuagcua

SEQ ID NO: 636 - RNA, 21 nt, Artificial Sequence
  Targeting domain
augggagaaggaaacuagcua

SEQ ID NO: 637 - RNA, 22 nt, Artificial Sequence
  Targeting domain
gaugggagaaggaaacuagcua

SEQ ID NO: 638 - RNA, 23 nt, Artificial Sequence
  Targeting domain
ugaugggagaaggaaacuagcua

SEQ ID NO: 639 - RNA, 24 nt, Artificial Sequence
  Targeting domain
augaugggagaaggaaacuagcua

SEQ ID NO: 640 - RNA, 18 nt, Artificial Sequence
  Targeting domain
aaagggaagaauaaauua

SEQ ID NO: 641 - RNA, 19 nt, Artificial Sequence
  Targeting domain
uaaagggaagaauaaauua

SEQ ID NO: 642 - RNA, 20 nt, Artificial Sequence
  Targeting domain
cuaaagggaagaauaaauua

SEQ ID NO: 643 - RNA, 21 nt, Artificial Sequence
  Targeting domain
gcuaaagggaagaauaaauua

SEQ ID NO: 644 - RNA, 22 nt, Artificial Sequence
  Targeting domain
agcuaaagggaagaauaaauua

SEQ ID NO: 645 - RNA, 23 nt, Artificial Sequence
  Targeting domain
uagcuaaagggaagaauaaauua

SEQ ID NO: 646 - RNA, 24 nt, Artificial Sequence
  Targeting domain
cuagcuaaagggaagaauaaauua

SEQ ID NO: 647 - RNA, 18 nt, Artificial Sequence
  Targeting domain
agaguauccagugaggcc

SEQ ID NO: 648 - RNA, 19 nt, Artificial Sequence
  Targeting domain
uagaguauccagugaggcc

SEQ ID NO: 649 - RNA, 21 nt, Artificial Sequence
  Targeting domain
cuuagaguauccagugaggcc

SEQ ID NO: 650 - RNA, 22 nt, Artificial Sequence
  Targeting domain
ucuuagaguauccagugaggcc

SEQ ID NO: 651 - RNA, 23 nt, Artificial Sequence
  Targeting domain
gucuuagaguauccagugaggcc

SEQ ID NO: 652 - RNA, 24 nt, Artificial Sequence
  Targeting domain
agucuuagaguauccagugaggcc

SEQ ID NO: 653 - RNA, 18 nt, Artificial Sequence
  Targeting domain
uagaguauccagugaggc

SEQ ID NO: 654 - RNA, 19 nt, Artificial Sequence
  Targeting domain
uuagaguauccagugaggc

SEQ ID NO: 655 - RNA, 20 nt, Artificial Sequence
  Targeting domain
cuuagaguauccagugaggc

SEQ ID NO: 656 - RNA, 21 nt, Artificial Sequence
  Targeting domain
ucuuagaguauccagugaggc

SEQ ID NO: 657 - RNA, 22 nt, Artificial Sequence
  Targeting domain
gucuuagaguauccagugaggc

SEQ ID NO: 658 - RNA, 23 nt, Artificial Sequence
  Targeting domain
agucuuagaguauccagugaggc

SEQ ID NO: 659 - RNA, 24 nt, Artificial Sequence
  Targeting domain
uagucuuagaguauccagugaggc

SEQ ID NO: 660 - RNA, 18 nt, Artificial Sequence
  Targeting domain
caggggccggcggcuggc

SEQ ID NO: 661 - RNA, 19 nt, Artificial Sequence
  Targeting domain
ccaggggccggcggcuggc

SEQ ID NO: 662 - RNA, 20 nt, Artificial Sequence
  Targeting domain
gccaggggccggcggcuggc

SEQ ID NO: 663 - RNA, 21 nt, Artificial Sequence
  Targeting domain
ggccaggggccggcggcuggc

SEQ ID NO: 664 - RNA, 22 nt, Artificial Sequence
  Targeting domain
aggccaggggccggcggcuggc

SEQ ID NO: 665 - RNA, 23 nt, Artificial Sequence
  Targeting domain
gaggccaggggccggcggcuggc

SEQ ID NO: 666 - RNA, 24 nt, Artificial Sequence
  Targeting domain
ugaggccaggggccggcggcuggc

SEQ ID NO: 667 - RNA, 18 nt, Artificial Sequence
  Targeting domain
aaaauuagcaguauccuc

SEQ ID NO: 668 - RNA, 19 nt, Artificial Sequence
  Targeting domain
aaaaauuagcaguauccuc

SEQ ID NO: 669 - RNA, 20 nt, Artificial Sequence
  Targeting domain
aaaaaauuagcaguauccuc

SEQ ID NO: 670 - RNA, 21 nt, Artificial Sequence
  Targeting domain
aaaaaaauuagcaguauccuc

SEQ ID NO: 671 - RNA, 22 nt, Artificial Sequence
  Targeting domain
aaaaaaaauuagcaguauccuc

SEQ ID NO: 672 - RNA, 23 nt, Artificial Sequence
  Targeting domain
uaaaaaaaauuagcaguauccuc

SEQ ID NO: 673 - RNA, 24 nt, Artificial Sequence
  Targeting domain
auaaaaaaaauuagcaguauccuc

SEQ ID NO: 674 - RNA, 18 nt, Artificial Sequence
  Targeting domain
guuccacacacucgcuuc

SEQ ID NO: 675 - RNA, 19 nt, Artificial Sequence
  Targeting domain
aguuccacacacucgcuuc

SEQ ID NO: 676 - RNA, 21 nt, Artificial Sequence
  Targeting domain
gcaguuccacacacucgcuuc

SEQ ID NO: 677 - RNA, 22 nt, Artificial Sequence
  Targeting domain
agcaguuccacacacucgcuuc

SEQ ID NO: 678 - RNA, 23 nt, Artificial Sequence
  Targeting domain
cagcaguuccacacacucgcuuc

SEQ ID NO: 679 - RNA, 24 nt, Artificial Sequence
  Targeting domain
ucagcaguuccacacacucgcuuc

SEQ ID NO: 680 - RNA, 18 nt, Artificial Sequence
  Targeting domain
uauccucuaugaugggag

SEQ ID NO: 681 - RNA, 19 nt, Artificial Sequence
  Targeting domain
guauccucuaugaugggag

SEQ ID NO: 682 - RNA, 20 nt, Artificial Sequence
  Targeting domain
gguauccucuaugaugggag

SEQ ID NO: 683 - RNA, 21 nt, Artificial Sequence
  Targeting domain
ugguauccucuaugaugggag

SEQ ID NO: 684 - RNA, 22 nt, Artificial Sequence
  Targeting domain
cugguauccucuaugaugggag

SEQ ID NO: 685 - RNA, 23 nt, Artificial Sequence
  Targeting domain
ccugguauccucuaugaugggag

SEQ ID NO: 686 - RNA, 24 nt, Artificial Sequence
  Targeting domain
uccugguauccucuaugaugggag

SEQ ID NO: 687 - RNA, 18 nt, Artificial Sequence
  Targeting domain
gccggcggcuggcuaggg

SEQ ID NO: 688 - RNA, 19 nt, Artificial Sequence
  Targeting domain
ggccggcggcuggcuaggg

SEQ ID NO: 689 - RNA, 20 nt, Artificial Sequence
  Targeting domain
gggccggcggcuggcuaggg

SEQ ID NO: 690 - RNA, 21 nt, Artificial Sequence
  Targeting domain
ggggccggcggcuggcuaggg

SEQ ID NO: 691 - RNA, 22 nt, Artificial Sequence
  Targeting domain
aggggccggcggcuggcuaggg

SEQ ID NO: 692 - RNA, 23 nt, Artificial Sequence
  Targeting domain
caggggccggcggcuggcuaggg

SEQ ID NO: 693 - RNA, 24 nt, Artificial Sequence
  Targeting domain
ccaggggccggcggcuggcuaggg

SEQ ID NO: 694 - RNA, 18 nt, Artificial Sequence
  Targeting domain
ugguauccucuaugaugg

SEQ ID NO: 695 - RNA, 19 nt, Artificial Sequence
  Targeting domain
cugguauccucuaugaugg

SEQ ID NO: 696 - RNA, 20 nt, Artificial Sequence
  Targeting domain
ccugguauccucuaugaugg

SEQ ID NO: 697 - RNA, 21 nt, Artificial Sequence
  Targeting domain
uccugguauccucuaugaugg

SEQ ID NO: 698 - RNA, 22 nt, Artificial Sequence
  Targeting domain
guccugguauccucuaugaugg

SEQ ID NO: 699 - RNA, 23 nt, Artificial Sequence
  Targeting domain
aguccugguauccucuaugaugg

SEQ ID NO: 700 - RNA, 24 nt, Artificial Sequence
  Targeting domain
aaguccugguauccucuaugaugg

SEQ ID NO: 701 - RNA, 18 nt, Artificial Sequence
  Targeting domain
guccugguauccucuaug

SEQ ID NO: 702 - RNA, 19 nt, Artificial Sequence
  Targeting domain
aguccugguauccucuaug

SEQ ID NO: 703 - RNA, 20 nt, Artificial Sequence
  Targeting domain
aaguccugguauccucuaug

SEQ ID NO: 704 - RNA, 21 nt, Artificial Sequence
  Targeting domain
gaaguccugguauccucuaug

SEQ ID NO: 705 - RNA, 22 nt, Artificial Sequence
  Targeting domain
agaaguccugguauccucuaug

SEQ ID NO: 706 - RNA, 23 nt, Artificial Sequence
  Targeting domain
aagaaguccugguauccucuaug

SEQ ID NO: 707 - RNA, 24 nt, Artificial Sequence
  Targeting domain
aaagaaguccugguauccucuaug

SEQ ID NO: 708 - RNA, 18 nt, Artificial Sequence
  Targeting domain
cuaaagggaagaauaaau

SEQ ID NO: 709 - RNA, 19 nt, Artificial Sequence
  Targeting domain
gcuaaagggaagaauaaau

SEQ ID NO: 710 - RNA, 20 nt, Artificial Sequence
  Targeting domain
agcuaaagggaagaauaaau

SEQ ID NO: 711 - RNA, 21 nt, Artificial Sequence
  Targeting domain
uagcuaaagggaagaauaaau

SEQ ID NO: 712 - RNA, 22 nt, Artificial Sequence
  Targeting domain
cuagcuaaagggaagaauaaau

SEQ ID NO: 713 - RNA, 23 nt, Artificial Sequence
  Targeting domain
acuagcuaaagggaagaauaaau

SEQ ID NO: 714 - RNA, 24 nt, Artificial Sequence
  Targeting domain
aacuagcuaaagggaagaauaaau

SEQ ID NO: 715 - RNA, 18 nt, Artificial Sequence
  Targeting domain
aaacuggaaugacugaau

SEQ ID NO: 716 - RNA, 19 nt, Artificial Sequence
  Targeting domain
aaaacuggaaugacugaau

SEQ ID NO: 717 - RNA, 21 nt, Artificial Sequence
  Targeting domain
gaaaaacuggaaugacugaau

SEQ ID NO: 718 - RNA, 22 nt, Artificial Sequence
  Targeting domain
agaaaaacuggaaugacugaau

SEQ ID NO: 719 - RNA, 23 nt, Artificial Sequence
  Targeting domain
gagaaaaacuggaaugacugaau

SEQ ID NO: 720 - RNA, 24 nt, Artificial Sequence
  Targeting domain
agagaaaaacuggaaugacugaau

SEQ ID NO: 721 - RNA, 18 nt, Artificial Sequence
  Targeting domain
ccugguauccucuaugau

SEQ ID NO: 722 - RNA, 19 nt, Artificial Sequence
  Targeting domain
uccugguauccucuaugau

SEQ ID NO: 723 - RNA, 21 nt, Artificial Sequence
  Targeting domain
aguccugguauccucuaugau

SEQ ID NO: 724 - RNA, 22 nt, Artificial Sequence
  Targeting domain
aaguccugguauccucuaugau

SEQ ID NO: 725 - RNA, 23 nt, Artificial Sequence
  Targeting domain
gaaguccugguauccucuaugau

SEQ ID NO: 726 - RNA, 24 nt, Artificial Sequence
  Targeting domain
agaaguccugguauccucuaugau

SEQ ID NO: 727 - RNA, 18 nt, Artificial Sequence
  Targeting domain
aaauuagcaguauccucu

SEQ ID NO: 728 - RNA, 19 nt, Artificial Sequence
  Targeting domain
aaaauuagcaguauccucu

SEQ ID NO: 729 - RNA, 21 nt, Artificial Sequence
  Targeting domain
aaaaaauuagcaguauccucu

SEQ ID NO: 730 - RNA, 22 nt, Artificial Sequence
  Targeting domain
aaaaaaauuagcaguauccucu

SEQ ID NO: 731 - RNA, 23 nt, Artificial Sequence
  Targeting domain
aaaaaaaauuagcaguauccucu

SEQ ID NO: 732 - RNA, 24 nt, Artificial Sequence
  Targeting domain
uaaaaaaaauuagcaguauccucu

SEQ ID NO: 733 - RNA, 18 nt, Artificial Sequence
  Targeting domain
cacucgcuucuggaacgu

SEQ ID NO: 734 - RNA, 19 nt, Artificial Sequence
  Targeting domain
acacucgcuucuggaacgu

SEQ ID NO: 735 - RNA, 20 nt, Artificial Sequence
  Targeting domain
cacacucgcuucuggaacgu

SEQ ID NO: 736 - RNA, 21 nt, Artificial Sequence
  Targeting domain
acacacucgcuucuggaacgu

SEQ ID NO: 737 - RNA, 22 nt, Artificial Sequence
  Targeting domain
cacacacucgcuucuggaacgu

SEQ ID NO: 738 - RNA, 23 nt, Artificial Sequence
  Targeting domain
ccacacacucgcuucuggaacgu

SEQ ID NO: 739 - RNA, 24 nt, Artificial Sequence
  Targeting domain
uccacacacucgcuucuggaacgu

SEQ ID NO: 740 - RNA, 18 nt, Artificial Sequence
  Targeting domain
cucaaugcaaauaucugu

SEQ ID NO: 741 - RNA, 19 nt, Artificial Sequence
  Targeting domain
ucucaaugcaaauaucugu

SEQ ID NO: 742 - RNA, 20 nt, Artificial Sequence
  Targeting domain
aucucaaugcaaauaucugu

SEQ ID NO: 743 - RNA, 21 nt, Artificial Sequence
  Targeting domain
uaucucaaugcaaauaucugu

SEQ ID NO: 744 - RNA, 22 nt, Artificial Sequence
  Targeting domain
cuaucucaaugcaaauaucugu

SEQ ID NO: 745 - RNA, 23 nt, Artificial Sequence
  Targeting domain
acuaucucaaugcaaauaucugu

SEQ ID NO: 746 - RNA, 24 nt, Artificial Sequence
  Targeting domain
cacuaucucaaugcaaauaucugu

SEQ ID NO: 747 - RNA, 18 nt, Artificial Sequence
  Targeting domain
aguuccacacacucgcuu

SEQ ID NO: 748 - RNA, 19 nt, Artificial Sequence
  Targeting domain
caguuccacacacucgcuu

SEQ ID NO: 749 - RNA, 20 nt, Artificial Sequence
  Targeting domain
gcaguuccacacacucgcuu

SEQ ID NO: 750 - RNA, 21 nt, Artificial Sequence
  Targeting domain
agcaguuccacacacucgcuu

SEQ ID NO: 751 - RNA, 22 nt, Artificial Sequence
  Targeting domain
cagcaguuccacacacucgcuu

SEQ ID NO: 752 - RNA, 23 nt, Artificial Sequence
  Targeting domain
ucagcaguuccacacacucgcuu

SEQ ID NO: 753 - RNA, 24 nt, Artificial Sequence
  Targeting domain
uucagcaguuccacacacucgcuu

SEQ ID NO: 754 - RNA, 18 nt, Artificial Sequence
  Targeting domain
aauuagcaguauccucuu

SEQ ID NO: 755 - RNA, 19 nt, Artificial Sequence
  Targeting domain
aaauuagcaguauccucuu

SEQ ID NO: 756 - RNA, 21 nt, Artificial Sequence
  Targeting domain
aaaaauuagcaguauccucuu

SEQ ID NO: 757 - RNA, 22 nt, Artificial Sequence
  Targeting domain
aaaaaauuagcaguauccucuu

SEQ ID NO: 758 - RNA, 23 nt, Artificial Sequence
  Targeting domain
aaaaaaauuagcaguauccucuu

SEQ ID NO: 759 - RNA, 24 nt, Artificial Sequence
  Targeting domain
aaaaaaaauuagcaguauccucuu

SEQ ID NO: 760 - RNA, 17 nt, Artificial Sequence
  Targeting domain
gaagaaaacuagcuaaa

SEQ ID NO: 761 - RNA, 17 nt, Artificial Sequence
  Targeting domain
gcagcaguauccucuug

SEQ ID NO: 762 - RNA, 20 nt, Artificial Sequence
  Targeting domain
ggagaagaaaacuagcuaaa

SEQ ID NO: 763 - RNA, 20 nt, Artificial Sequence
  Targeting domain
gggagaagaaaacuagcuaa

SEQ ID NO: 764 - RNA, 20 nt, Artificial Sequence
  Targeting domain
guccugguaucuucuauggu

SEQ ID NO: 765 - RNA, 17 nt, Artificial Sequence
  Targeting domain
agaagaaaacuagcuaa

SEQ ID NO: 766 - RNA, 17 nt, Artificial Sequence
  Targeting domain
aguccugguaucuucua

SEQ ID NO: 767 - RNA, 17 nt, Artificial Sequence
  Targeting domain
ccaccauagaagauacc

SEQ ID NO: 768 - RNA, 17 nt, Artificial Sequence
  Targeting domain
ccugguaucuucuaugg

SEQ ID NO: 769 - RNA, 17 nt, Artificial Sequence
  Targeting domain
cagcaguauccucuugg

SEQ ID NO: 770 - RNA, 17 nt, Artificial Sequence
  Targeting domain
aauuggaaugacugaau

SEQ ID NO: 771 - RNA, 17 nt, Artificial Sequence
  Targeting domain
cugguaucuucuauggu

SEQ ID NO: 772 - RNA, 17 nt, Artificial Sequence
  Targeting domain
agcagcaguauccucuu

SEQ ID NO: 773 - RNA, 20 nt, Artificial Sequence
  Targeting domain
agaaguccugguaucuucua

SEQ ID NO: 774 - RNA, 20 nt, Artificial Sequence
  Targeting domain
cucccaccauagaagauacc

SEQ ID NO: 775 - RNA, 20 nt, Artificial Sequence
  Targeting domain
aguccugguaucuucuaugg

SEQ ID NO: 776 - RNA, 20 nt, Artificial Sequence
  Targeting domain
aagcagcaguauccucuugg

SEQ ID NO: 777 - RNA, 20 nt, Artificial Sequence
  Targeting domain
uaagcagcaguauccucuug

SEQ ID NO: 778 - RNA, 20 nt, Artificial Sequence
  Targeting domain
agaauaaauuagagaaaaau

SEQ ID NO: 779 - RNA, 20 nt, Artificial Sequence
  Targeting domain
aaaaauuggaaugacugaau

SEQ ID NO: 780 - RNA, 20 nt, Artificial Sequence
  Targeting domain
auuaagcagcaguauccucu

SEQ ID NO: 781 - RNA, 20 nt, Artificial Sequence
  Targeting domain
uuaagcagcaguauccucuu

SEQ ID NO: 782 - RNA, 17 nt, Artificial Sequence
  Targeting domain
auaaauuagagaaaaau

SEQ ID NO: 783 - RNA, 17 nt, Artificial Sequence
  Targeting domain
aagcagcaguauccucu

SEQ ID NO: 784 - RNA, 20 nt, Artificial Sequence
  Targeting domain
gaagaaaacuagcuaaaggg

SEQ ID NO: 785 - RNA, 22 nt, Artificial Sequence
  Targeting domain
gagaagaaaacuagcuaaaggg

SEQ ID NO: 786 - RNA, 23 nt, Artificial Sequence
  Targeting domain
ggagaagaaaacuagcuaaaggg

SEQ ID NO: 787 - RNA, 24 nt, Artificial Sequence
  Targeting domain
gggagaagaaaacuagcuaaaggg

SEQ ID NO: 788 - RNA, 19 nt, Artificial Sequence
  Targeting domain
gaauaaauuagagaaaaau

SEQ ID NO: 789 - RNA, 22 nt, Artificial Sequence
  Targeting domain
gaagaauaaauuagagaaaaau

SEQ ID NO: 790 - RNA, 23 nt, Artificial Sequence
  Targeting domain
ggaagaauaaauuagagaaaaau

SEQ ID NO: 791 - RNA, 24 nt, Artificial Sequence
  Targeting domain
gggaagaauaaauuagagaaaaau

SEQ ID NO: 792 - RNA, 18 nt, Artificial Sequence
  Targeting domain
agagaaaaauuggaauga

SEQ ID NO: 793 - RNA, 19 nt, Artificial Sequence
  Targeting domain
uagagaaaaauuggaauga

SEQ ID NO: 794 - RNA, 20 nt, Artificial Sequence
  Targeting domain
uuagagaaaaauuggaauga

SEQ ID NO: 795 - RNA, 21 nt, Artificial Sequence
  Targeting domain
auuagagaaaaauuggaauga

SEQ ID NO: 796 - RNA, 22 nt, Artificial Sequence
  Targeting domain
aauuagagaaaaauuggaauga

SEQ ID NO: 797 - RNA, 23 nt, Artificial Sequence
  Targeting domain
aaauuagagaaaaauuggaauga

SEQ ID NO: 798 - RNA, 24 nt, Artificial Sequence
  Targeting domain
uaaauuagagaaaaauuggaauga

SEQ ID NO: 799 - RNA, 18 nt, Artificial Sequence
  Targeting domain
agaaaacuagcuaaaggg

SEQ ID NO: 800 - RNA, 19 nt, Artificial Sequence
  Targeting domain
aagaaaacuagcuaaaggg

SEQ ID NO: 801 - RNA, 21 nt, Artificial Sequence
  Targeting domain
agaagaaaacuagcuaaaggg

SEQ ID NO: 802 - RNA, 18 nt, Artificial Sequence
  Targeting domain
aauaaauuagagaaaaau

SEQ ID NO: 803 - RNA, 21 nt, Artificial Sequence
  Targeting domain
aagaauaaauuagagaaaaau

SEQ ID NO: 804 - RNA, 18 nt, Artificial Sequence
  Targeting domain
aguuuucuucucccacca

SEQ ID NO: 805 - RNA, 19 nt, Artificial Sequence
  Targeting domain
uaguuuucuucucccacca

SEQ ID NO: 806 - RNA, 20 nt, Artificial Sequence
  Targeting domain
cuaguuuucuucucccacca

SEQ ID NO: 807 - RNA, 21 nt, Artificial Sequence
  Targeting domain
gcuaguuuucuucucccacca

SEQ ID NO: 808 - RNA, 22 nt, Artificial Sequence
  Targeting domain
agcuaguuuucuucucccacca

SEQ ID NO: 809 - RNA, 23 nt, Artificial Sequence
  Targeting domain
uagcuaguuuucuucucccacca

SEQ ID NO: 810 - RNA, 24 nt, Artificial Sequence
  Targeting domain
uuagcuaguuuucuucucccacca

SEQ ID NO: 811 - RNA, 18 nt, Artificial Sequence
  Targeting domain
ucccaccauagaagauac

SEQ ID NO: 812 - RNA, 19 nt, Artificial Sequence
  Targeting domain
cucccaccauagaagauac

SEQ ID NO: 813 - RNA, 20 nt, Artificial Sequence
  Targeting domain
ucucccaccauagaagauac

SEQ ID NO: 814 - RNA, 21 nt, Artificial Sequence
  Targeting domain
uucucccaccauagaagauac

SEQ ID NO: 815 - RNA, 22 nt, Artificial Sequence
  Targeting domain
cuucucccaccauagaagauac

SEQ ID NO: 816 - RNA, 23 nt, Artificial Sequence
  Targeting domain
ucuucucccaccauagaagauac

SEQ ID NO: 817 - RNA, 24 nt, Artificial Sequence
  Targeting domain
uucuucucccaccauagaagauac

SEQ ID NO: 818 - RNA, 18 nt, Artificial Sequence
  Targeting domain
agaagaaaacuagcuaaa

SEQ ID NO: 819 - RNA, 19 nt, Artificial Sequence
  Targeting domain
gagaagaaaacuagcuaaa

SEQ ID NO: 820 - RNA, 21 nt, Artificial Sequence
  Targeting domain
gggagaagaaaacuagcuaaa

SEQ ID NO: 821 - RNA, 22 nt, Artificial Sequence
  Targeting domain
ugggagaagaaaacuagcuaaa

SEQ ID NO: 822 - RNA, 23 nt, Artificial Sequence
  Targeting domain
gugggagaagaaaacuagcuaaa

SEQ ID NO: 823 - RNA, 24 nt, Artificial Sequence
  Targeting domain
ggugggagaagaaaacuagcuaaa

SEQ ID NO: 824 - RNA, 18 nt, Artificial Sequence
  Targeting domain
aaaauuggaaugacugaa

SEQ ID NO: 825 - RNA, 19 nt, Artificial Sequence
  Targeting domain
aaaaauuggaaugacugaa

SEQ ID NO: 826 - RNA, 20 nt, Artificial Sequence
  Targeting domain
gaaaaauuggaaugacugaa

SEQ ID NO: 827 - RNA, 21 nt, Artificial Sequence
  Targeting domain
agaaaaauuggaaugacugaa

SEQ ID NO: 828 - RNA, 22 nt, Artificial Sequence
  Targeting domain
gagaaaaauuggaaugacugaa

SEQ ID NO: 829 - RNA, 23 nt, Artificial Sequence
  Targeting domain
agagaaaaauuggaaugacugaa

SEQ ID NO: 830 - RNA, 24 nt, Artificial Sequence
  Targeting domain
uagagaaaaauuggaaugacugaa

SEQ ID NO: 831 - RNA, 18 nt, Artificial Sequence
  Targeting domain
gagaagaaaacuagcuaa

SEQ ID NO: 832 - RNA, 19 nt, Artificial Sequence
  Targeting domain
ggagaagaaaacuagcuaa

SEQ ID NO: 833 - RNA, 21 nt, Artificial Sequence
  Targeting domain
ugggagaagaaaacuagcuaa

SEQ ID NO: 834 - RNA, 22 nt, Artificial Sequence
  Targeting domain
gugggagaagaaaacuagcuaa

SEQ ID NO: 835 - RNA, 23 nt, Artificial Sequence
  Targeting domain
ggugggagaagaaaacuagcuaa

SEQ ID NO: 836 - RNA, 24 nt, Artificial Sequence
  Targeting domain
uggugggagaagaaaacuagcuaa

SEQ ID NO: 837 - RNA, 18 nt, Artificial Sequence
  Targeting domain
ggagaagaaaacuagcua

SEQ ID NO: 838 - RNA, 19 nt, Artificial Sequence
  Targeting domain
gggagaagaaaacuagcua

SEQ ID NO: 839 - RNA, 20 nt, Artificial Sequence
  Targeting domain
ugggagaagaaaacuagcua

SEQ ID NO: 840 - RNA, 21 nt, Artificial Sequence
  Targeting domain
gugggagaagaaaacuagcua

SEQ ID NO: 841 - RNA, 22 nt, Artificial Sequence
  Targeting domain
ggugggagaagaaaacuagcua

SEQ ID NO: 842 - RNA, 23 nt, Artificial Sequence
  Targeting domain
uggugggagaagaaaacuagcua

SEQ ID NO: 843 - RNA, 24 nt, Artificial Sequence
  Targeting domain
auggugggagaagaaaacuagcua

SEQ ID NO: 844 - RNA, 18 nt, Artificial Sequence
  Targeting domain
uuaagcagcaguauccuc

SEQ ID NO: 845 - RNA, 19 nt, Artificial Sequence
  Targeting domain
auuaagcagcaguauccuc

SEQ ID NO: 846 - RNA, 20 nt, Artificial Sequence
  Targeting domain
aauuaagcagcaguauccuc

SEQ ID NO: 847 - RNA, 21 nt, Artificial Sequence
  Targeting domain
aaauuaagcagcaguauccuc

SEQ ID NO: 848 - RNA, 22 nt, Artificial Sequence
  Targeting domain
aaaauuaagcagcaguauccuc

SEQ ID NO: 849 - RNA, 23 nt, Artificial Sequence
  Targeting domain
aaaaauuaagcagcaguauccuc

SEQ ID NO: 850 - RNA, 24 nt, Artificial Sequence
  Targeting domain
aaaaaauuaagcagcaguauccuc

SEQ ID NO: 851 - RNA, 18 nt, Artificial Sequence
  Targeting domain
uaucuucuauggugggag

SEQ ID NO: 852 - RNA, 19 nt, Artificial Sequence
  Targeting domain
guaucuucuauggugggag

SEQ ID NO: 853 - RNA, 20 nt, Artificial Sequence
  Targeting domain
gguaucuucuauggugggag

SEQ ID NO: 854 - RNA, 21 nt, Artificial Sequence
  Targeting domain
ugguaucuucuauggugggag

SEQ ID NO: 855 - RNA, 22 nt, Artificial Sequence
  Targeting domain
cugguaucuucuauggugggag

SEQ ID NO: 856 - RNA, 23 nt, Artificial Sequence
  Targeting domain
ccugguaucuucuauggugggag

SEQ ID NO: 857 - RNA, 24 nt, Artificial Sequence
  Targeting domain
uccugguaucuucuauggugggag

SEQ ID NO: 858 - RNA, 18 nt, Artificial Sequence
  Targeting domain
uccugguaucuucuaugg

SEQ ID NO: 859 - RNA, 19 nt, Artificial Sequence
  Targeting domain
guccugguaucuucuaugg

SEQ ID NO: 860 - RNA, 21 nt, Artificial Sequence
  Targeting domain
aaguccugguaucuucuaugg

SEQ ID NO: 861 - RNA, 22 nt, Artificial Sequence
  Targeting domain
gaaguccugguaucuucuaugg

SEQ ID NO: 862 - RNA, 23 nt, Artificial Sequence
  Targeting domain
agaaguccugguaucuucuaugg

SEQ ID NO: 863 - RNA, 24 nt, Artificial Sequence
  Targeting domain
aagaaguccugguaucuucuaugg

SEQ ID NO: 864 - RNA, 18 nt, Artificial Sequence
  Targeting domain
ugguaucuucuauggugg

SEQ ID NO: 865 - RNA, 19 nt, Artificial Sequence
  Targeting domain
cugguaucuucuauggugg

SEQ ID NO: 866 - RNA, 20 nt, Artificial Sequence
  Targeting domain
ccugguaucuucuauggugg

SEQ ID NO: 867 - RNA, 21 nt, Artificial Sequence
  Targeting domain
uccugguaucuucuauggugg

SEQ ID NO: 868 - RNA, 22 nt, Artificial Sequence
  Targeting domain
guccugguaucuucuauggugg

SEQ ID NO: 869 - RNA, 23 nt, Artificial Sequence
  Targeting domain
aguccugguaucuucuauggugg

SEQ ID NO: 870 - RNA, 24 nt, Artificial Sequence
  Targeting domain
aaguccugguaucuucuauggugg

SEQ ID NO: 871 - RNA, 18 nt, Artificial Sequence
  Targeting domain
guccugguaucuucuaug

SEQ ID NO: 872 - RNA, 19 nt, Artificial Sequence
  Targeting domain
aguccugguaucuucuaug

SEQ ID NO: 873 - RNA, 20 nt, Artificial Sequence
  Targeting domain
aaguccugguaucuucuaug

SEQ ID NO: 874 - RNA, 21 nt, Artificial Sequence
  Targeting domain
gaaguccugguaucuucuaug

SEQ ID NO: 875 - RNA, 22 nt, Artificial Sequence
  Targeting domain
agaaguccugguaucuucuaug

SEQ ID NO: 876 - RNA, 23 nt, Artificial Sequence
  Targeting domain
aagaaguccugguaucuucuaug

SEQ ID NO: 877 - RNA, 24 nt, Artificial Sequence
  Targeting domain
aaagaaguccugguaucuucuaug

SEQ ID NO: 878 - RNA, 18 nt, Artificial Sequence
  Targeting domain
aaauuggaaugacugaau

SEQ ID NO: 879 - RNA, 19 nt, Artificial Sequence
  Targeting domain
aaaauuggaaugacugaau

SEQ ID NO: 880 - RNA, 21 nt, Artificial Sequence
  Targeting domain
gaaaaauuggaaugacugaau

SEQ ID NO: 881 - RNA, 22 nt, Artificial Sequence
  Targeting domain
agaaaaauuggaaugacugaau

SEQ ID NO: 882 - RNA, 23 nt, Artificial Sequence
  Targeting domain
gagaaaaauuggaaugacugaau

SEQ ID NO: 883 - RNA, 24 nt, Artificial Sequence
  Targeting domain
agagaaaaauuggaaugacugaau

SEQ ID NO: 884 - RNA, 18 nt, Artificial Sequence
  Targeting domain
uaagcagcaguauccucu

SEQ ID NO: 885 - RNA, 19 nt, Artificial Sequence
  Targeting domain
uuaagcagcaguauccucu

SEQ ID NO: 886 - RNA, 21 nt, Artificial Sequence
  Targeting domain
aauuaagcagcaguauccucu

SEQ ID NO: 887 - RNA, 22 nt, Artificial Sequence
  Targeting domain
aaauuaagcagcaguauccucu

SEQ ID NO: 888 - RNA, 23 nt, Artificial Sequence
  Targeting domain
aaaauuaagcagcaguauccucu

SEQ ID NO: 889 - RNA, 24 nt, Artificial Sequence
  Targeting domain
aaaaauuaagcagcaguauccucu

SEQ ID NO: 890 - RNA, 18 nt, Artificial Sequence
  Targeting domain
ccugguaucuucuauggu

SEQ ID NO: 891 - RNA, 19 nt, Artificial Sequence
  Targeting domain
uccugguaucuucuauggu

SEQ ID NO: 892 - RNA, 21 nt, Artificial Sequence
  Targeting domain
aguccugguaucuucuauggu

SEQ ID NO: 893 - RNA, 22 nt, Artificial Sequence
  Targeting domain
aaguccugguaucuucuauggu

SEQ ID NO: 894 - RNA, 23 nt, Artificial Sequence
  Targeting domain
gaaguccugguaucuucuauggu

SEQ ID NO: 895 - RNA, 24 nt, Artificial Sequence
  Targeting domain
agaaguccugguaucuucuauggu

SEQ ID NO: 896 - RNA, 18 nt, Artificial Sequence
  Targeting domain
aagcagcaguauccucuu

SEQ ID NO: 897 - RNA, 19 nt, Artificial Sequence
  Targeting domain
uaagcagcaguauccucuu

SEQ ID NO: 898 - RNA, 21 nt, Artificial Sequence
  Targeting domain
auuaagcagcaguauccucuu

SEQ ID NO: 899 - RNA, 22 nt, Artificial Sequence
  Targeting domain
aauuaagcagcaguauccucuu

SEQ ID NO: 900 - RNA, 23 nt, Artificial Sequence
  Targeting domain
aaauuaagcagcaguauccucuu

SEQ ID NO: 901 - RNA, 24 nt, Artificial Sequence
  Targeting domain
aaaauuaagcagcaguauccucuu

SEQ ID NO: 902 - DNA, 4758 bp, Homo sapiens
  misc_feature (2716)..(2719): HPFH deletion site (4 bp del -225 to -222)
  misc_feature (2748)..(2753): GATA1 binding motif
  misc_feature (2762)..(2767): GATA1 binding motif
  misc_feature (2791)..(2799): FKLF transcription factor binding motif
  misc_feature (2823)..(2830): CP1/Coup TFII binding motif
  misc_feature (2824)..(2836): HPFH deletion site (13 bp del -114 to -102)
  misc_feature (2991)..(2993): Start codon
tttaggaagtcaaggtttaggcagggatagccattctattttattaggggcaatactatttccaacggcatctggcttttctcagcccttgtgaggctctacagggaggttgaggtgttagagatcagagcaggaaacaggtttttctttccacggtaactacaatgaagtgatccttactttactaaggaacttttcattttaagtgttgacgcatgcctaaagaggtgaaattaatcccatacccttaagtctacagactggtcacagcatttcaaggaggagacctcattgtaagcttctagggaggtggggacttaggtgaaggaaatgagccagcagaagctcacaagtcagcatcagcgtgtcatgtctcagcagcagaacagcacggtcagatgaaaatatagtgtgaagaatttgtataacattaattgagaaggcagattcactggagttcttatataattgaaagttaatgcacgttaataagcaagagtttagtttaatgtgatggtgttatgaacttaacgcttgtgtctccagaaaattcacatgctgaatccccaactcccaattggctccatttgtgggggaggctttggaaaagtaatcaggtttagaggagctcatgagagcagatccccatcatagaattattttcctcatcagaagcagagagattagccatttctcttccttctggtgaggacacagtgggaagtcagccacctgcaacccaggaagagagccctgaccaggaaccagcagaaaagtgagaaaaaatcctgttgttgaagtcacccagtctatgctattttgttatagcaccttgcactaagtaaggcagatgaagaaagagaaaaaaataagcttcggtgttcagtggattagaaaccatgtttatctcaggtttacaaatctccacttgtcctctgtgtttcagaataaaataccaactctactactctcatctgtaagatgcaaatagtaagcctgagcccttctgtctaactttgaattctattttttcttcaacgtactttaggcttgtaatgtgtttatatacagtgaaatgtcaagttctttctttatatttctttctttcttttttttcctcagcctcagagttttccacatgcccttcctactttcaggaacttctttctccaaacgtcttctgcctggctccatcaaatcataaaggacccacttcaaatgccatcactcactaccatttcacaattcgcactttctttctttgtcctttttttttttagtaaaacaagtttataaaaaattgaaggaataaatgaatggctacttcataggcagagtagacgcaagggctactggttgccgatttttattgttatttttcaatagtatgctaaacaaggggtagattatttatgctgcccatttttagaccataaaagataacttcctgatgttgccatggcatttttttccttttaattttatttcatttcattttaatttcgaaggtacatgtgcaggatgtgcaggcttgttacatgggtaaatgtgtgtctttctggccttttagccatctgtatcaatgagcagatataagctttacacaggatcatgaaggatgaaagaatttcaccaatattataataatttcaatcaacctgatagcttaggggataaactaatttgaagatacagcttgcctccgataagccagaattccagagcttctggcattataatctagcaaggttagagatcatggatcactttcagagaaaaacaaaaacaaactaaccaaaagcaaaacagaaccaaaaaaccaccataaatacttcctaccctgttaatggtccaatatgtcagaaacagcactgtgttagaaataaagctgtctaaagtacactaatattcgagttataatagtgtgtggactattagtcaataaaaacaacccttgcctctttagagttgttttccatgtacacgcacatcttatgtcttagagtaagattccctgagaagtgaacctagcatttatacaagataattaattctaatccacagtacctgccaaagaacattctaccatcatctttactgagcatagaagagctacgccaaaaccctgggtcatcagccagcacacacacttatccagtggtaaatacacatcatctggtgtatacatacatacctgaatatggaatcaaatatttttctaagatgaaacagtcatgatttatttcaaataggtacggataagtagatattgaggtaagcattaggtcttatattatgtaacactaatctattactgcgctgaaactgtggctttatagaaattgttttcactgcactattgagaaattaagagataatggcaaaagtcacaaagagtatattcaaaaagaagtatagcactttttccttagaaaccactgctaactgaaagagactaagatttgtcccgtcaaaaatcctggacctatgcctaaaacacatttcacaatccctgaacttttcaaaaattggtacatgctttagctttaaactacaggcctcactggagctagagacaagaaggtaaaaaacggctgacaaaagaagtcctggtatcctctatgatgggagaaggaaactagctaaagggaagaataaattagagaaaaactggaatgactgaatcggaacaaggcaaaggctataaaaaaaattagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaaggtgagtccaggagatgtttcagccctgttgcctttagtctcgaggcaacttagacaacggagtattgatctgagcacagcagggtgtgagctgtttgaagatactggggttgggggtgaagaaactgcagaggactaactgggctgagacccagtggtaatgttttagggcctaaggagtgcctctaaaaatctagatggacaattttgactttgagaaaagagaggtggaaatgaggaaaatgacttttctttattagattccagtagaaagaactttcatctttccctcatttttgttgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgcgcgcgcgcgtgtgtgtgtgtgtgtcagcgtgtgtttcttttaacgtcttcagcctacaacatacagggttcatggtggcaagaagatagcaagatttaaattatggccagtgactagtgcttgaaggggaacaactacctgcatttaatgggaaggcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgtacacgggagttctgcaagtgggagtaaatggtgtaggagaaatccg

SEQ ID NO: 903 - DNA, 4773 bp, Homo sapiens
  misc_feature (1233)..(1238): GATA1 binding site
  misc_feature (2672)..(2677): GATA1 binding site
  misc_feature (2686)..(2691): GATA1 binding site
  misc_feature (2715)..(2723): FKLF transcription factor binding motif
  misc_feature (2747)..(2754): CP1/Coup TFII binding motif
  misc_feature (2748)..(2760): HPFH deletion site (13 bp del -114 to -102)
  misc_feature (2915)..(2917): Start codon
ttatgtcattaccagagttaaaattctataatggcttctcactccctaccactgaggacaagtttatgtccttaggtttatgcttccctgaaacaataccacctgctattctccactttacatatcaacggcactggttctttatctaactctctggcacagcaggagtttgttttcttctgcttcagagctttgaatttactatttcagcttctaaactttatttggcaatgccttcccatggcagattccttctgtcattttgcctctgttcgaatactttctccttaatttcattcttagttaataatatctgaaattattttgttgtttaacttaattattaattttatgtatgttctacctagattataatcttcagaggaaagttttattctctgacttatttaacttaaatgcccactactttaaaaattatgacatttatttaacagatatttgctgaacaaatgtttgaaaatacatgggaaagaatgcttgaaaacacttgaaattgcttgtgtaaagaaacagttttatcagttaggatttaatcaatgtcagaagcaatgatataggaaaaatcgaggaataagacagttatggataaggagaaatcaacaaactcttaaaagatattgcctcaaaagcataagaggaaataagggtttatacatgacttttagaacactgccttggtttttggataaatggggaagttgtttgaaaacaggagggatcctagatattccttagtctgaggaggagcaattaagattcacttgtttagaggctgggagtggtggctcacgcctgtaatcccagaattttgggaggccaaggcaggcagatcacctgaggtcaagagttcaagaccaacctggccaacatggtgaaatcccatctctacaaaaatacaaaaattagacaggcatgatggcaagtgcctgtaatcccagctacttgggaggctgaggaaggagaattgcttgaacctggaaggcaggagttgcagtgagccgagatcataccactgcactccagcctgggtgacagaacaagactctgtctcaaaaaaaaaaaagagagattcaaaagattcacttgtttaggccttagcgggcttagacaccagtctctgacacattcttaaaggtcaggctctacaaatggaacccaaccagactctcagatatggccaaagatctatacacacccatctcacagatcccctatcttaaagagaccctaatttgggttcacctcagtctctataatctgtaccagcataccaataaaaatctttctcacccatccttagattgagagaagtcacttattattatgtgagtaactggaagatactgataagttgacaaatctttttctttcctttcttattcaacttttattttaacttccaaagaacaagtgcaatatgtgcagctttgttgcgcaggtcaacatgtatctttctggtcttttagccgcctaacactttgagcagatataagccttacacaggattatgaagtctgaaaggattccaccaatattattataattcctatcaacctgataggttaggggaaggtagagctctcctccaataagccagatttccagagtttctgacgtcataatctaccaaggtcatggatcgagttcagagaaaaaacaaaagcaaaaccaaacctaccaaaaaataaaaatcccaaagaaaaaataaagaaaaaaacagcatgaatacttcctgccatgttaagtggccaatatgtcagaaacagcactgagttacagataaagatgtctaaactacagtgacatcccagctgtcacagtgtgtggactattagtcaataaaacagtccctgcctcttaagagttgttttccatgcaaatacatgtcttatgtcttagaataagattccctaagaagtgaacctagcatttatacaagataattaattctaatccatagtatctggtaaagagcattctaccatcatctttaccgagcatagaagagctacaccaaaaccctgggtcatcagccagcacatacacttatccagtgataaatacacatcatcgggtgcctacatacatacctgaatataaaaaaaatacttttgctgagatgaaacaggcgtgatttatttcaaataggtacggataagtagatattgaagtaaggattcagtcttatattatattacataacattaatctattcctgcactgaaactgttgctttataggatttttcactacactaatgagaacttaagagataatggcctaaaaccacagagagtatattcaaagataagtatagcacttcttatttggaaaccaatgcttactaaatgagactaagacgtgtcccatcaaaaatcctggacctatgcctaaaacacatttcacaatccctgaacttttcaaaaattggtacatgctttaactttaaactacaggcctcactggagctacagacaagaaggtgaaaaacggctgacaaaagaagtcctggtatcttctatggtgggagaagaaaactagctaaagggaagaataaattagagaaaaattggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggcaatgttttagggcctaaggagtgcctctgaaaatctagatggacaactttgactttgagaaaagagaggtggaaatgaggaaaatgacttttctttattagatttcggtagaaagaactttcacctttcccctatttttgttattcgttttaaaacatctatctggaggcaggacaagtatggtcattaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgcgcgcgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactggagtggccagtgccctgtcctccagataccactgagctcactgcccatgatgcagagctttcaaggataggctttattctgcaagcaatcaaataataaatctattctgctaagagatcacacatggttgtcttcagttctttttttatgtctttttaaatatatgagccacaaagggttttatgttgagggatgtgtttatgtgtatttatacatggctatgtgtgtttgtgtcatgtgcacactccacacttttttgtttacgttagatgtgggttttgatgagcaaataaaagaactaggcaataaagaaacttgtacatgggagttctgcaagtgggagtaaaaggtgcaggagaaatctggttggaagaaagacctctataggacaggactcctcagaaacagatgttttggaagagatggggaaaggttcagtgaa

SEQ ID NO: 904 - DNA, 87 bp, Artificial Sequence
  ssODN1 5' homology arm
gggtgcttccttttattcttcatccctagccagccgccggcccctggcctcactggatactctaagactattggtcaagtttgcctt

SEQ ID NO: 905 - DNA, 89 bp, Artificial Sequence
  ssODN1 3' homology arm
gtcaaggcaaggctggccaacccatgggtggagtttagccagggaccgtttcagacagatatttgcattgagatagtgtggggaagggg

SEQ ID NO: 906 - DNA, 176 bp, Artificial Sequence
  ssODN1
gggtgcttccttttattcttcatccctagccagccgccggcccctggcctcactggatactctaagactattggtcaagtttgccttgtcaaggcaaggctggccaacccatgggtggagtttagccagggaccgtttcagacagatatttgcattgagatagtgtggggaagggg

SEQ ID NO: 907 - DNA, 87 bp, Artificial Sequence; identical to SEQ ID NO: 904
  PhTx ssODN1 5' homology arm
  misc_feature (1)..(2): Linked by phosphorothioate (PS) bond

SEQ ID NO: 908 - DNA, 89 bp, Artificial Sequence; identical to SEQ ID NO: 905
  PhTx ssODN1 3' homology arm
  misc_feature (88)..(89): Linked by phosphorothioate (PS) bond

SEQ ID NO: 909 - DNA, 176 bp, Artificial Sequence; identical to SEQ ID NO: 906
  PhTx ssODN1
  misc_feature (1)..(2): Linked by phosphorothioate (PS) bond
  misc_feature (175)..(176): Linked by phosphorothioate (PS) bond

SEQ ID NO: 910 - DNA, 17 bp, Artificial Sequence
  targeting domain
ggctattggtcaaggca

SEQ ID NO: 911 - DNA, 20 bp, Artificial Sequence
  targeting domain
caaggctattggtcaaggca

SEQ ID NO: 912 - DNA, 17 bp, Artificial Sequence
  targeting domain
tgccttgtcaaggctat

SEQ ID NO: 913 - DNA, 20 bp, Artificial Sequence
  targeting domain
gtttgccttgtcaaggctat

SEQ ID NO: 914 - DNA, 17 bp, Artificial Sequence
  targeting domain
gaccaatagccttgaca

SEQ ID NO: 915 - DNA, 20 bp, Artificial Sequence
  targeting domain
cttgaccaatagccttgaca

SEQ ID NO: 916 - DNA, 17 bp, Artificial Sequence
  targeting domain
gtcaaggctattggtca

SEQ ID NO: 917 - DNA, 20 bp, Artificial Sequence
  targeting domain
cttgtcaaggctattggtca

SEQ ID NO: 918 - DNA, 17 bp, Artificial Sequence
  targeting domain
tcaagtttgccttgtca

SEQ ID NO: 919 - DNA, 20 bp, Artificial Sequence
  targeting domain
tggtcaagtttgccttgtca

SEQ ID NO: 920 - RNA, 20 nt, Artificial Sequence
  targeting domain plus PAM (NGG)
ggcuauuggucaaggcaagg

SEQ ID NO: 921 - RNA, 23 nt, Artificial Sequence
  targeting domain plus PAM (NGG)
caaggcuauuggucaaggcaagg

SEQ ID NO: 922 - RNA, 20 nt, Artificial Sequence
  targeting domain plus PAM (NGG)
ugccuugucaaggcuauugg

SEQ ID NO: 923 - RNA, 23 nt, Artificial Sequence
  targeting domain plus PAM (NGG)
guuugccuugucaaggcuauugg

SEQ ID NO: 924 - RNA, 20 nt, Artificial Sequence
  targeting domain plus PAM (NGG)
gaccaauagccuugacaagg

SEQ ID NO: 925 - RNA, 23 nt, Artificial Sequence
  targeting domain plus PAM (NGG)
cuugaccaauagccuugacaagg

SEQ ID NO: 926 - RNA, 20 nt, Artificial Sequence
  targeting domain plus PAM (NGG)
gucaaggcuauuggucaagg

SEQ ID NO: 927 - RNA, 23 nt, Artificial Sequence
  targeting domain plus PAM (NGG)
cuugucaaggcuauuggucaagg

SEQ ID NO: 928 - RNA, 20 nt, Artificial Sequence
  targeting domain plus PAM (NGG)
ucaaguuugccuugucaagg

SEQ ID NO: 929 - RNA, 23 nt, Artificial Sequence
  targeting domain plus PAM (NGG)
uggucaaguuugccuugucaagg

SEQ ID NO: 930 - DNA, 20 bp, Artificial Sequence
  targeting domain plus PAM (NGG)
ggctattggtcaaggcaagg

SEQ ID NO: 931 - DNA, 23 bp, Artificial Sequence
  targeting domain plus PAM (NGG)
caaggctattggtcaaggcaagg

SEQ ID NO: 932 - DNA, 20 bp, Artificial Sequence
  targeting domain plus PAM (NGG)
tgccttgtcaaggctattgg

SEQ ID NO: 933 - DNA, 23 bp, Artificial Sequence
  targeting domain plus PAM (NGG)
gtttgccttgtcaaggctattgg

SEQ ID NO: 934 - DNA, 20 bp, Artificial Sequence
  targeting domain plus PAM (NGG)
gaccaatagccttgacaagg

SEQ ID NO: 935 - DNA, 23 bp, Artificial Sequence
  targeting domain plus PAM (NGG)
cttgaccaatagccttgacaagg

SEQ ID NO: 936 - DNA, 20 bp, Artificial Sequence
  targeting domain plus PAM (NGG)
gtcaaggctattggtcaagg

SEQ ID NO: 937 - DNA, 23 bp, Artificial Sequence
  targeting domain plus PAM (NGG)
cttgtcaaggctattggtcaagg

SEQ ID NO: 938 - DNA, 20 bp, Artificial Sequence
  targeting domain plus PAM (NGG)
tcaagtttgccttgtcaagg

SEQ ID NO: 939 - DNA, 23 bp, Artificial Sequence
  targeting domain plus PAM (NGG)
tggtcaagtttgccttgtcaagg

SEQ ID NO: 940 - RNA, 17 nt, Artificial Sequence
  targeting domain
aguauccagugaggcca

SEQ ID NO: 941 - RNA, 20 nt, Artificial Sequence
  targeting domain
ggcaaggcuggccaacccau

SEQ ID NO: 942 - RNA, 20 nt, Artificial Sequence
  targeting domain
uauuugcauugagauagugu

SEQ ID NO: 943 - DNA, 17 bp, Artificial Sequence
  targeting domain
agtatccagtgaggcca

SEQ ID NO: 944 - DNA, 20 bp, Artificial Sequence
  targeting domain
ggcaaggctggccaacccat

SEQ ID NO: 945 - DNA, 20 bp, Artificial Sequence
  targeting domain
tatttgcattgagatagtgt

SEQ ID NO: 946 - RNA, 20 nt, Artificial Sequence
  targeting domain plus PAM (NGG)
aguauccagugaggccaggg

SEQ ID NO: 947 - RNA, 23 nt, Artificial Sequence
  targeting domain plus PAM (NGG)
ggcaaggcuggccaacccauggg

SEQ ID NO: 948 - RNA, 23 nt, Artificial Sequence
  targeting domain plus PAM (NGG)
uauuugcauugagauaguguggg

SEQ ID NO: 949 - DNA, 20 bp, Artificial Sequence
  targeting domain plus PAM (NGG)
agtatccagtgaggccaggg

SEQ ID NO: 950 - DNA, 23 bp, Artificial Sequence
  targeting domain plus PAM (NGG)
ggcaaggctggccaacccatggg

SEQ ID NO: 951 - DNA, 23 bp, Artificial Sequence
  targeting domain plus PAM (NGG)
tatttgcattgagatagtgtggg

SEQ ID NO: 952 - RNA, 20 nt, Artificial Sequence
  targeting domain
cuaacaguugcuuuuaucac

SEQ ID NO: 953 - RNA, 20 nt, Artificial Sequence
  targeting domain
gggcgugggugggguagaag

SEQ ID NO: 954 - RNA, 20 nt, Artificial Sequence
  targeting domain
cucuuagacauaacacacca

SEQ ID NO: 955 - RNA, 20 nt, Artificial Sequence
  targeting domain
aucagaggccaaacccuucc

SEQ ID NO: 956 - DNA, 20 bp, Artificial Sequence
  targeting domain
ctaacagttgcttttatcac

SEQ ID NO: 957 - DNA, 20 bp, Artificial Sequence
  targeting domain
gggcgtgggtggggtagaag

SEQ ID NO: 958 - DNA, 20 bp, Artificial Sequence
  targeting domain
ctcttagacataacacacca

SEQ ID NO: 959 - DNA, 20 bp, Artificial Sequence
  targeting domain
atcagaggccaaacccttcc

SEQ ID NO: 960 - RNA, 23 nt, Artificial Sequence
  targeting domain plus PAM (NGG)
cuaacaguugcuuuuaucacagg

SEQ ID NO: 961 - RNA, 23 nt, Artificial Sequence
  targeting domain plus PAM (NGG)
gggcgugggugggguagaagagg

SEQ ID NO: 962 - RNA, 23 nt, Artificial Sequence
  targeting domain plus PAM (NGG)
cucuuagacauaacacaccaggg

SEQ ID NO: 963 - RNA, 23 nt, Artificial Sequence
  targeting domain plus PAM (NGG)
aucagaggccaaacccuuccugg

SEQ ID NO: 964 - DNA, 23 bp, Artificial Sequence
  targeting domain plus PAM (NGG)
ctaacagttgcttttatcacagg

SEQ ID NO: 965 - DNA, 23 bp, Artificial Sequence
  targeting domain plus PAM (NGG)
gggcgtgggtggggtagaagagg

SEQ ID NO: 966 - DNA, 23 bp, Artificial Sequence
  targeting domain plus PAM (NGG)
ctcttagacataacacaccaggg

SEQ ID NO: 967 - DNA, 23 bp, Artificial Sequence
  targeting domain plus PAM (NGG)
atcagaggccaaacccttcctgg

SEQ ID NO: 968 - DNA, 115 bp, Artificial Sequence
  +58 DHS enhancer
caactttgaagctagtctagtgcaagctaacagttgcttttatcacaggctccaggaagggtttggcctctgattagggtgggggcgtgggtggggtagaagaggactggcagac

SEQ ID NO: 969 - DNA, 801 bp, Artificial Sequence
  +58 DHS enhancer region including ~500 bp upstream and ~200 bp downstream
aggtaccttttgtgtgtatgtgctgattgagggcccattgagaatattttgacttttagggaagctccaaactctcaaaccacagggatcacaacacatacgtgtgtctgttatgacgttatatgtaagcatcacaacaggcagagaatgtctgcaccccaccctggaaaacagcctgactgtgccccatgggcaaaccagactagtttatagggggttctactctgaggtactgatggaccttgggtgctattcctgtgataaggaaggcagctagacaggacttgggagttatctgtagtgagatggctgaaaagcgatacagggctggctctatgccccaggtgtgcataagtaagagcagatagctgattccagtgcaaagtccatacaggtaataacataggccagaaaagagatatggcatctactcttagacataacacaccagggtcaatacaactttgaagctagtctagtgcaagctaacagttgcttttatcacaggctccaggaagggtttggcctctgattagggtgggggcgtgggtggggtagaagaggactggcagacctctccatcggtggccgtttgcccaggggggcctctttcggaaggctctcttggtgatggagaattggattttatttctcaatgggaatgaaataatttgtatgccatgccgtgtggactcccaaaattgtaaaggaggtgaagcttcccctgtctgcactctcccctcctcataattgtccatttttcatctgtcgggctgtccacccatccatcacatataggca

SEQ ID NO: 970 - RNA, 100 nt, Artificial Sequence
  Unmodified Sp35 gRNA (OLI7066)
cuugucaaggcuauuggucaguuuuagagcuagaaauagcaaguuaaaauaaggcuaguccguuaucaacuugaaaaaguggcaccgagucggugcuuuu

SEQ ID NO: 971 - RNA, 100 nt, Artificial Sequence; identical to SEQ ID NO: 970
  Sp35 gRNA w/ 5' and 3' PS/OMe (OLI8394)
  misc_feature (1)..(1): Modified to contain 2'-O-methyl
  misc_feature (1)..(2): Linked by phosphorothioate (PS) bond
  misc_feature (2)..(3): Linked by phosphorothioate (PS) bond
  misc_feature (2)..(2): Modified to contain 2'-O-methyl
  misc_feature (3)..(4): Linked by phosphorothioate (PS) bond
  misc_feature (3)..(3): Modified to contain 2'-O-methyl
  misc_feature (97)..(98): Linked by phosphorothioate (PS) bond
  misc_feature (97)..(97): Modified to contain 2'-O-methyl
  misc_feature (98)..(99): Linked by phosphorothioate (PS) bond
  misc_feature (98)..(98): Modified to contain 2'-O-methyl
  misc_feature (99)..(100): Linked by phosphorothioate (PS) bond
  misc_feature (99)..(99): Modified to contain 2'-O-methyl

SEQ ID NO: 972 - DNA, 100 bp, Artificial Sequence
  Unmodified Sp35 gRNA (OLI7066)
cttgtcaaggctattggtcagttttagagctagaaatagcaagttaaaataaggctagtccgttatcaacttgaaaaagtggcaccgagtcggtgctttt

SEQ ID NO: 973 - DNA, 100 bp, Artificial Sequence; identical to SEQ ID NO: 972
  Sp35 gRNA w/ 5' and 3' PS/OMe (OLI8394)
  misc_feature (1)..(1): Modified to contain 2'-O-methyl
  misc_feature (1)..(2): Linked by phosphorothioate (PS) bond
  misc_feature (2)..(2): Modified to contain 2'-O-methyl
  misc_feature (2)..(3): Linked by phosphorothioate (PS) bond
  misc_feature (3)..(3): Modified to contain 2'-O-methyl
  misc_feature (3)..(4): Linked by phosphorothioate (PS) bond
  misc_feature (97)..(97): Modified to contain 2'-O-methyl
  misc_feature (97)..(98): Linked by phosphorothioate (PS) bond
  misc_feature (98)..(98): Modified to contain 2'-O-methyl
  misc_feature (98)..(99): Linked by phosphorothioate (PS) bond
  misc_feature (99)..(99): Modified to contain 2'-O-methyl
  misc_feature (99)..(100): Linked by phosphorothioate (PS) bond

SEQ ID NO: 974 - DNA, 180 bp, Artificial Sequence
  Ptx ssODN 18nt - positive strand (OLI16409)
  misc_feature (1)..(2): Linked by phosphorothioate (PS) bond
  misc_feature (179)..(180): Linked by phosphorothioate (PS) bond
ggtgcttccttttattcttcatccctagccagccgccggcccctggcctcactggatactctaagactattggtcaagtttgccttgtcaaggctggccaacccatgggtggagtttagccagggaccgtttcagacagatatttgcattgagatagtgtggggaaggggcccccaagag

SEQ ID NO: 975 - DNA, 180 bp, Artificial Sequence
  Ptx ssODN 18nt - negative strand (OLI16410)
  misc_feature (1)..(2): Linked by phosphorothioate (PS) bond
  misc_feature (179)..(180): Linked by phosphorothioate (PS) bond
ctcttgggggccccttccccacactatctcaatgcaaatatctgtctgaaacggtccctggctaaactccacccatgggttggccagccttgacaaggcaaacttgaccaatagtcttagagtatccagtgaggccaggggccggcggctggctagggatgaagaataaaaggaagcacc

SEQ ID NO: 976 - DNA, 180 bp, Artificial Sequence
  Ptx ssODN 11nt - negative strand (OLI16411)
  misc_feature (1)..(2): Linked by phosphorothioate (PS) bond
  misc_feature (179)..(180): Linked by phosphorothioate (PS) bond
ggccccttccccacactatctcaatgcaaatatctgtctgaaacggtccctggctaaactccacccatgggttggccagccttgccttgagacaaggcaaacttgaccaatagtcttagagtatccagtgaggccaggggccggcggctggctagggatgaagaataaaaggaagcaccc

SEQ ID NO: 977 - DNA, 180 bp, Artificial Sequence
  Ptx ssODN 13nt - negative strand (OLI16412)
  misc_feature (1)..(2): Linked by phosphorothioate (PS) bond
  misc_feature (179)..(180): Linked by phosphorothioate (PS) bond
ggccccttccccacactatctcaatgcaaatatctgtctgaaacggtccctggctaaactccacccatgggttggccagccttgccttgacaaggcaaacttgaccaatagtcttagagtatccagtgaggccaggggccggcggctggctagggatgaagaataaaaggaagcaccctt

SEQ ID NO: 978 - DNA, 180 bp, Artificial Sequence
  Ptx ssODN 11nt - positive strand (OLI16413)
  misc_feature (1)..(2): Linked by phosphorothioate (PS) bond
  misc_feature (179)..(180): Linked by phosphorothioate (PS) bond
gggtgcttccttttattcttcatccctagccagccgccggcccctggcctcactggatactctaagactattggtcaagtttgccttgtctcaaggcaaggctggccaacccatgggtggagtttagccagggaccgtttcagacagatatttgcattgagatagtgtggggaaggggcc

SEQ ID NO: 979 - DNA, 180 bp, Artificial Sequence
  Ptx ssODN 13nt - positive strand (OLI16414)
  misc_feature (1)..(2): Linked by phosphorothioate (PS) bond
  misc_feature (179)..(180): Linked by phosphorothioate (PS) bond
aagggtgcttccttttattcttcatccctagccagccgccggcccctggcctcactggatactctaagactattggtcaagtttgccttgtcaaggcaaggctggccaacccatgggtggagtttagccagggaccgtttcagacagatatttgcattgagatagtgtggggaaggggcc

SEQ ID NO: 980 - DNA, 180 bp, Artificial Sequence
  Ptx ssODN 117G>A - negative strand (OLI16415)
  misc_feature (1)..(2): Linked by phosphorothioate (PS) bond
  misc_feature (179)..(180): Linked by phosphorothioate (PS) bond
ggccccttccccacactatctcaatgcaaatatctgtctgaaacggtccctggctaaactccacccatgggttggccagccttgccttaaccaatagccttgacaaggcaaacttgaccaatagtcttagagtatccagtgaggccaggggccggcggctggctagggatgaagaataaa

SEQ ID NO: 981 - DNA, 180 bp, Artificial Sequence
  Ptx ssODN 117G>A - positive strand (OLI16416)
  misc_feature (1)..(2): Linked by phosphorothioate (PS) bond
  misc_feature (179)..(180): Linked by phosphorothioate (PS) bond
tttattcttcatccctagccagccgccggcccctggcctcactggatactctaagactattggtcaagtttgccttgtcaaggctattggttaaggcaaggctggccaacccatgggtggagtttagccagggaccgtttcagacagatatttgcattgagatagtgtggggaaggggcc

SEQ ID NO: 982 - DNA, 180 bp, Artificial Sequence
  Ptx ssODN 1nt - negative strand (OLI16417)
  misc_feature (1)..(2): Linked by phosphorothioate (PS) bond
  misc_feature (179)..(180): Linked by phosphorothioate (PS) bond
ggccccttccccacactatctcaatgcaaatatctgtctgaaacggtccctggctaaactccacccatgggttggccagccttgccttgccaatagccttgacaaggcaaacttgaccaatagtcttagagtatccagtgaggccaggggccggcggctggctagggatgaagaataaaa

SEQ ID NO: 983 - DNA, 180 bp, Artificial Sequence
  Ptx ssODN 1nt - positive strand (OLI16418)
  misc_feature (1)..(2): Linked by phosphorothioate (PS) bond
  misc_feature (179)..(180): Linked by phosphorothioate (PS) bond
ttttattcttcatccctagccagccgccggcccctggcctcactggatactctaagactattggtcaagtttgccttgtcaaggctattggcaaggcaaggctggccaacccatgggtggagtttagccagggaccgtttcagacagatatttgcattgagatagtgtggggaaggggcc

SEQ ID NO: 984 - DNA, 120 bp, Artificial Sequence
  Ptx ssODN 4nt 40/80 - negative strand (OLI16419)
  misc_feature (1)..(2): Linked by phosphorothioate (PS) bond
  misc_feature (119)..(120): Linked by phosphorothioate (PS) bond
tggctaaactccacccatgggttggccagccttgccttgatagccttgacaaggcaaacttgaccaatagtcttagagtatccagtgaggccaggggccggcggctggctagggatgaag

SEQ ID NO: 985 - DNA, 100 bp, Artificial Sequence
  Ptx ssODN 4nt 30/70 - negative strand (OLI16420)
  misc_feature (1)..(2): Linked by phosphorothioate (PS) bond
  misc_feature (99)..(100): Linked by phosphorothioate (PS) bond
ccacccatgggttggccagccttgccttgatagccttgacaaggcaaacttgaccaatagtcttagagtatccagtgaggccaggggccggcggctggct

SEQ ID NO: 986 - DNA, 100 bp, Artificial Sequence
  Ptx ssODN 4nt - negative strand (OLI16421)
  misc_feature (1)..(2): Linked by phosphorothioate (PS) bond
  misc_feature (99)..(100): Linked by phosphorothioate (PS) bond
aaacggtccctggctaaactccacccatgggttggccagccttgccttgatagccttgacaaggcaaacttgaccaatagtcttagagtatccagtgagg

SEQ ID NO: 987 - DNA, 120 bp, Artificial Sequence
  Ptx ssODN 4nt - negative strand (OLI16422)
  misc_feature (1)..(2): Linked by phosphorothioate (PS) bond
  misc_feature (119)..(120): Linked by phosphorothioate (PS) bond
tatctgtctgaaacggtccctggctaaactccacccatgggttggccagccttgccttgatagccttgacaaggcaaacttgaccaatagtcttagagtatccagtgaggccaggggccg

SEQ ID NO: 988 - DNA, 140 bp, Artificial Sequence
  Ptx ssODN 4nt - negative strand (OLI16423)
  misc_feature (1)..(2): Linked by phosphorothioate (PS) bond
  misc_feature (139)..(140): Linked by phosphorothioate (PS) bond
tcaatgcaaatatctgtctgaaacggtccctggctaaactccacccatgggttggccagccttgccttgatagccttgacaaggcaaacttgaccaatagtcttagagtatccagtgaggccaggggccggcggctggct

SEQ ID NO: 989 - DNA, 180 bp, Artificial Sequence
  Ptx ssODN 4nt - negative strand (OLI16424)
  misc_feature (1)..(2): Linked by phosphorothioate (PS) bond
  misc_feature (179)..(180): Linked by phosphorothioate (PS) bond
ggccccttccccacactatctcaatgcaaatatctgtctgaaacggtccctggctaaactccacccatgggttggccagccttgccttgatagccttgacaaggcaaacttgaccaatagtcttagagtatccagtgaggccaggggccggcggctggctagggatgaagaataaaagga

SEQ ID NO: 990 - DNA, 120 bp, Artificial Sequence
  Ptx ssODN 4nt 40/80 - positive strand (OLI16425)
  misc_feature (1)..(2): Linked by phosphorothioate (PS) bond
  misc_feature (119)..(120): Linked by phosphorothioate (PS) bond
tactctaagactattggtcaagtttgccttgtcaaggctatcaaggcaaggctggccaacccatgggtggagtttagccagggaccgtttcagacagatatttgcattgagatagtgtgg

SEQ ID NO: 991 - DNA, 100 bp, Artificial Sequence
  Ptx ssODN 4nt 30/70 - positive strand (OLI16426)
  misc_feature (1)..(2): Linked by phosphorothioate (PS) bond
  misc_feature (99)..(100): Linked by phosphorothioate (PS) bond
ctattggtcaagtttgccttgtcaaggctatcaaggcaaggctggccaacccatgggtggagtttagccagggaccgtttcagacagatatttgcattga

SEQ ID NO: 992 - DNA, 100 bp, Artificial Sequence
  Ptx ssODN 4nt - positive strand (OLI16427)
  misc_feature (1)..(2): Linked by phosphorothioate (PS) bond
  misc_feature (99)..(100): Linked by phosphorothioate (PS) bond
cctcactggatactctaagactattggtcaagtttgccttgtcaaggctatcaaggcaaggctggccaacccatgggtggagtttagccagggaccgttt

SEQ ID NO: 993 - DNA, 120 bp, Artificial Sequence
  Ptx ssODN 4nt - positive strand (OLI16428)
  misc_feature (1)..(2): Linked by phosphorothioate (PS) bond
  misc_feature (119)..(120): Linked by phosphorothioate (PS) bond
cggcccctggcctcactggatactctaagactattggtcaagtttgccttgtcaaggctatcaaggcaaggctggccaacccatgggtggagtttagccagggaccgtttcagacagata

SEQ ID NO: 994 - DNA, 140 bp, Artificial Sequence
  Ptx ssODN 4nt - positive strand (OLI16429)
  misc_feature (1)..(2): Linked by phosphorothioate (PS) bond
  misc_feature (139)..(140): Linked by phosphorothioate (PS) bond
agccagccgccggcccctggcctcactggatactctaagactattggtcaagtttgccttgtcaaggctatcaaggcaaggctggccaacccatgggtggagtttagccagggaccgtttcagacagatatttgcattga

SEQ ID NO: 995 - DNA, 180 bp, Artificial Sequence
  Ptx ssODN 4nt - positive strand (OLI16430)
  misc_feature (1)..(2): Linked by phosphorothioate (PS) bond
  misc_feature (179)..(180): Linked by phosphorothioate (PS) bond
tccttttattcttcatccctagccagccgccggcccctggcctcactggatactctaagactattggtcaagtttgccttgtcaaggctatcaaggcaaggctggccaacccatgggtggagtttagccagggaccgtttcagacagatatttgcattgagatagtgtggggaaggggcc

SEQ ID NO: 996 - RNA, 100 nt, Artificial Sequence
  Sp37 gRNA (OLI17075)
cuugaccaauagccuugacaguuuuagagcuagaaauagcaaguuaaaauaaggcuaguccguuaucaacuugaaaaaguggcaccgagucggugcuuuu

SEQ ID NO: 997 - RNA, 100 nt, Artificial Sequence
  SpA gRNA (OLI17074)
ggcaaggcuggccaacccauguuuuagagcuagaaauagcaaguuaaaauaaggcuaguccguuaucaacuugaaaaaguggcaccgagucggugcuuuu

SEQ ID NO: 998 - DNA, 100 bp, Artificial Sequence
  Sp37 gRNA (OLI17075)
cttgaccaatagccttgacagttttagagctagaaatagcaagttaaaataaggctagtccgttatcaacttgaaaaagtggcaccgagtcggtgctttt

SEQ ID NO: 999 - DNA, 100 bp, Artificial Sequence
  SpA gRNA (OLI17074)
ggcaaggctggccaacccatgttttagagctagaaatagcaagttaaaataaggctagtccgttatcaacttgaaaaagtggcaccgagtcggtgctttt

SEQ ID NO: 1000 - protein, 1332 aa, Artificial Sequence
  His-AsCpf1-nNLS
MKHHHHHHMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKG

SEQ ID NO: 1001 - protein, 1333 aa, Artificial Sequence
  His-AsCpf1-sNLS-sNLS
MKHHHHHHMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKVGSPKKKRKV

SEQ ID NO: 1002 - RNA, 20 nt, Artificial Sequence
  HBG1-1 gRNA (OLI13620) targeting domain
ccuugucaaggcuauugguc

SEQ ID NO: 1003 - DNA, 20 bp, Artificial Sequence
  HBG1-1 gRNA (OLI13620) targeting domain
ccttgtcaaggctattggtc

SEQ ID NO: 1004 - RNA, 24 nt, Artificial Sequence
  HBG1-1 gRNA (OLI13620) targeting domain plus PAM
uuugccuugucaaggcuauugguc

SEQ ID NO: 1005 - DNA, 24 bp, Artificial Sequence
  HBG1-1 gRNA (OLI13620) targeting domain plus PAM
tttgccttgtcaaggctattggtc

SEQ ID NO: 1006 - protein, 16 aa, Artificial Sequence
  Nucleoplasmin NLS
KRPAATKKAGQAKKKK

SEQ ID NO: 1007 - protein, 7 aa, Artificial Sequence
  Simian Virus 40 NLS
PKKKRKV

SEQ ID NO: 1008 - protein, 1324 aa, Artificial Sequence
  His-AsCpf1-sNLS
  MISC_FEATURE (3)..(8): His tag
  MISC_FEATURE (1318)..(1324): SV40 NLS
MKHHHHHHMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKV

SEQ ID NO: 1009 - protein, 1326 aa, Artificial Sequence
  His-sNLS-AsCpf1
  MISC_FEATURE (3)..(8): His tag
  MISC_FEATURE (11)..(17): SV40 NLS
MKHHHHHHGSPKKKRKVGSMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1010 - protein, 1333 aa, Artificial Sequence
  His-sNLS-sNLS-AsCpf1
  MISC_FEATURE (3)..(8): His tag
  MISC_FEATURE (11)..(17): SV40 NLS
  MISC_FEATURE (20)..(26): SV40 NLS
MKHHHHHHGSPKKKRKVGSPKKKRKVMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1011 - protein, 1327 aa, Artificial Sequence
  sNLS-sNLS-AsCpf1
  MISC_FEATURE (5)..(11): SV40 NLS
  MISC_FEATURE (14)..(20): SV40 NLS
MKGSPKKKRKVGSPKKKRKVMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1012 - protein, 1332 aa, Artificial Sequence
  His-sNLS-AsCpf1-sNLS
  MISC_FEATURE (3)..(8): His tag
  MISC_FEATURE (10)..(16): SV40 NLS
  MISC_FEATURE (1325)..(1331): SV40 NLS
MKHHHHHHMPKKKRKVMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGPKKKRKVG

SEQ ID NO: 1013 - protein, 1352 aa, Artificial Sequence
  His-sNLS-sNLS-AsCpf1-sNLS-sNLS
  MISC_FEATURE (3)..(8): His tag
  MISC_FEATURE (11)..(17): SV40 NLS
  MISC_FEATURE (20)..(26): SV40 NLS
  MISC_FEATURE (1337)..(1343): SV40 NLS
  MISC_FEATURE (1346)..(1352): SV40 NLS
MGHHHHHHGSPKKKRKVGSPKKKRKVGSTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKVGSPKKKRKV

SEQ ID NO: 1014 - protein, 1332 aa, Artificial Sequence
  His-AsCpf1-nNLS Cys-less
  MISC_FEATURE (3)..(8): His tag
  MISC_FEATURE (1316)..(1331): Nucleoplasmin NLS
MKHHHHHHMTQFEGFTNLYQVSKTLRFELIPQGKTLKHIQEQGFIEEDKARNDHYKELKPIIDRIYKTYADQSLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENSHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFSKYKTLLRNENVLETAEALFNELNSIDLTHIFISHKKLETISSALSDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKSSTQLKAVTAHFQTHTTPILLSNNFIEPLEITKEIYDLNNPEKEPKKFQTAYAKKTGDQKGYREALSKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNSLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVSFDSRFQNPEWPMDADANGAYHIALKGQLLLNHLKESKDLKLQNGISNQDWLAYIQELRNKRPAATKKAGQAKKKKG

SEQ ID NO: 1015 - protein, 1332 aa, Artificial Sequence
  His-AsCpf1-nNLS Cys-low
  MISC_FEATURE (3)..(8): His tag
  MISC_FEATURE (1316)..(1331): Nucleoplasmin NLS
MKHHHHHHMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFSKYKTLLRNENVLETAEALFNELNSIDLTHIFISHKKLETISSALSDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALSKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKKG

SEQ ID NO: 1016 - protein, 1307 aa, Acidaminococcus sp. strain BV3L6
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1017 - protein, 1228 aa, Lachnospiraceae bacterium ND2006
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1018 - protein, 1206 aa, Lachnospiraceae bacterium MA2020
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSNIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFSDTASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGYLSQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 1019 - DNA, 4059 bp, Acidaminococcus sp. strain BV3L6
atgacccagttcgagggcttcaccaacctgtaccaggtgagcaagaccctgcggttcgagctgatcccccagggcaagaccctgaagcacatccaggagcagggcttcatcgaggaggacaaggcccggaacgaccactacaaggagctgaagcccatcatcgaccggatctacaagacctacgccgaccagtgcctgcagctggtgcagctggactgggagaacctgagcgccgccatcgacagctaccggaaggagaagaccgaggagacccggaacgccctgatcgaggagcaggccacctaccggaacgccatccacgactacttcatcggccggaccgacaacctgaccgacgccatcaacaagcggcacgccgagatctacaagggcctgttcaaggccgagctgttcaacggcaaggtgctgaagcagctgggcaccgtgaccaccaccgagcacgagaacgccctgctgcggagcttcgacaagttcaccacctacttcagcggcttctacgagaaccggaagaacgtgttcagcgccgaggacatcagcaccgccatcccccaccggatcgtgcaggacaacttccccaagttcaaggagaactgccacatcttcacccggctgatcaccgccgtgcccagcctgcgggagcacttcgagaacgtgaagaaggccatcggcatcttcgtgagcaccagcatcgaggaggtgttcagcttccccttctacaaccagctgctgacccagacccagatcgacctgtacaaccagctgctgggcggcatcagccgggaggccggcaccgagaagatcaagggcctgaacgaggtgctgaacctggccatccagaagaacgacgagaccgcccacatcatcgccagcctgccccaccggttcatccccctgttcaagcagatcctgagcgaccggaacaccctgagcttcatcctggaggagttcaagagcgacgaggaggtgatccagagcttctgcaagtacaagaccctgctgcggaacgagaacgtgctggagaccgccgaggccctgttcaacgagctgaacagcatcgacctgacccacatcttcatcagccacaagaagctggagaccatcagcagcgccctgtgcgaccactgggacaccctgcggaacgccctgtacgagcggcggatcagcgagctgaccggcaagatcaccaagagcgccaaggagaaggtgcagcggagcctgaagcacgaggacatcaacctgcaggagatcatcagcgccgccggcaaggagctgagcgaggccttcaagcagaagaccagcgagatcctgagccacgcccacgccgccctggaccagcccctgcccaccaccctgaagaagcaggaggagaaggagatcctgaaaagccagctggacagcctgctgggcctgtaccacctgctggactggttcgccgtggacgagagcaacgaggtggaccccgagttcagcgcccggctgaccggcatcaagctggagatggagcccagcctgagcttctacaacaaggcccggaactacgccaccaagaagccctacagcgtggagaagttcaagctgaacttccagatgcccaccctggccagcggctgggacgtgaacaaggagaagaacaacggcgccatcctgttcgtgaagaacggcctgtactacctgggcatcatgcccaagcagaagggccggtacaaggccctgagcttcgagcccaccgagaagaccagcgagggcttcgacaagatgtactacgactacttccccgacgccgccaagatgatccccaagtgcagcacccagctgaaggccgtgaccgcccacttccagacccacaccacccccatcctgctgagcaacaacttcatcgagcccctggagatcaccaaggagatctacgacctgaacaaccccgagaaggagcccaagaagttccagaccgcctacgccaagaagaccggcgaccagaagggctaccgggaggccctgtgcaagtggatcgacttcacccgggacttcctgagcaagtacaccaagaccaccagcatcgacctgagcagcctgcggcccagcagccagtacaaggacctgggcgagtactacgccgagctgaaccccctgctgtaccacatcagcttccagcggatcgccgagaaggagatcatggacgccgtggagaccggcaagctgtacctgttccagatctacaacaaggacttcgccaagggccaccacggcaagcccaacctgcacaccctgtactggaccggcctgttcagccccgagaacctggccaagaccagcatcaagctgaacggccaggccgagctgttctaccggcccaagagccggatgaagcggatggcccaccggctgggcgagaagatgctgaacaagaagctgaaggaccagaagacccccatccccgacaccctgtaccaggagctgtacgactacgtgaaccaccggctgagccacgacctgagcgacgaggcccgggccctgctgcccaacgtgatcaccaaggaggtgagccacgagatcatcaaggaccggcggttcaccagcgacaagttcttcttccacgtgcccatcaccctgaactaccaggccgccaacagccccagcaagttcaaccagcgggtgaacgcctacctgaaggagcaccccgagacccccatcatcggcatcgaccggggcgagcggaacctgatctacatcaccgtgatcgacagcaccggcaagatcctggagcagcggagcctgaacaccatccagcagttcgactaccagaagaagctggacaaccgggagaaggagcgggtggccgcccggcaggcctggagcgtggtgggcaccatcaaggacctgaagcagggctacctgagccaggtgatccacgagatcgtggacctgatgatccactaccaggccgtggtggtgctggagaacctgaacttcggcttcaagagcaagcggaccggcatcgccgagaaggccgtgtaccagcagttcgagaagatgctgatcgacaagctgaactgcctggtgctgaaggactaccccgccgagaaggtgggcggcgtgctgaacccctaccagctgaccgaccagttcaccagcttcgccaagatgggcacccagagcggcttcctgttctacgtgcccgccccctacaccagcaagatcgaccccctgaccggcttcgtggaccccttcgtgtggaagaccatcaagaaccacgagagccggaagcacttcctggagggcttcgacttcctgcactacgacgtgaagaccggcgacttcatcctgcacttcaagatgaaccggaacctgagcttccagcggggcctgcccggcttcatgcccgcctgggacatcgtgttcgagaagaacgagacccagttcgacgccaagggcacccccttcatcgccggcaagcggatcgtgcccgtgatcgagaaccaccggttcaccggccggtaccgggacctgtaccccgccaacgagctgatcgccctgctggaggagaagggcatcgtgttccgggacggcagcaacatcctgcccaagctgctggagaacgacgacagccacgccatcgacaccatggtggccctgatccggagcgtgctgcagatgcggaacagcaacgccgccaccggcgaggactacatcaacagccccgtgcgggacctgaacggcgtgtgcttcgacagccggttccagaaccccgagtggcccatggacgccgacgccaacggcgcctaccacatcgccctgaagggccagctgctgctgaaccacctgaaggagagcaaggacctgaagctgcagaacggcatcagcaaccaggactggctggcctacatccaggagctgcggaacaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 1020 - DNA, 3822 bp, Lachnospiraceae bacterium ND2006
atgagcaagctggagaagttcaccaactgctacagcctgagcaagaccctgcggttcaaggccatccccgtgggcaagacccaggagaacatcgacaacaagcggctgctggtggaggacgagaagcgggccgaggactacaagggcgtgaagaagctgctggaccggtactacctgagcttcatcaacgacgtgctgcacagcatcaagctgaagaacctgaacaactacatcagcctgttccggaagaagacccggaccgagaaggagaacaaggagctggagaacctggagatcaacctgcggaaggagatcgccaaggccttcaagggcaacgagggctacaagagcctgttcaagaaggacatcatcgagaccatcctgcccgagttcctggacgacaaggacgagatcgccctggtgaacagcttcaacggcttcaccaccgccttcaccggcttcttcgacaaccgggagaacatgttcagcgaggaggccaagagcaccagcatcgccttccggtgcatcaacgagaacctgacccggtacatcagcaacatggacatcttcgagaaggtggacgccatcttcgacaagcacgaggtgcaggagatcaaggagaagatcctgaacagcgactacgacgtggaggacttcttcgagggcgagttcttcaacttcgtgctgacccaggagggcatcgacgtgtacaacgccatcatcggcggcttcgtgaccgagagcggcgagaagatcaagggcctgaacgagtacatcaacctgtacaaccagaagaccaagcagaagctgcccaagttcaagcccctgtacaagcaggtgctgagcgaccgggagagcctgagcttctacggcgagggctacaccagcgacgaggaggtgctggaggtgttccggaacaccctgaacaagaacagcgagatcttcagcagcatcaagaagctggagaagctgttcaagaacttcgacgagtacagcagcgccggcatcttcgtgaagaacggccccgccatcagcaccatcagcaaggacatcttcggcgagtggaacgtgatccgggacaagtggaacgccgagtacgacgacatccacctgaagaagaaggccgtggtgaccgagaagtacgaggacgaccggcggaaaagcttcaagaagatcggcagcttcagcctggagcagctgcaggagtacgccgacgccgacctgagcgtggtggagaagctgaaggagatcatcatccagaaggtggacgagatctacaaggtgtacggcagcagcgagaagctgttcgacgccgacttcgtgctggagaaaagcctgaagaagaacgacgccgtggtggccatcatgaaggacctgctggacagcgtgaaaagcttcgagaactacatcaaggccttcttcggcgagggcaaggagaccaaccgggacgagagcttctacggcgacttcgtgctggcctacgacatcctgctgaaggtggaccacatctacgacgccatccggaactacgtgacccagaagccctacagcaaggacaagttcaagctgtacttccagaacccccagttcatgggcggctgggacaaggacaaggagaccgactaccgggccaccatcctgcggtacggcagcaagtactacctggccatcatggacaagaagtacgccaagtgcctgcagaagatcgacaaggacgacgtgaacggcaactacgagaagatcaactacaagctgctgcccggccccaacaagatgctgcccaaggtgttcttcagcaagaagtggatggcctactacaaccccagcgaggacatccagaagatctacaagaacggcaccttcaagaagggcgacatgttcaacctgaacgactgccacaagctgatcgacttcttcaaggacagcatcagccggtaccccaagtggagcaacgcctacgacttcaacttcagcgagaccgagaagtacaaggacatcgccggcttctaccgggaggtggaggagcagggctacaaggtgagcttcgagagcgccagcaagaaggaggtggacaagctggtggaggagggcaagctgtacatgttccagatctacaacaaggacttcagcgacaagagccacggcacccccaacctgcacaccatgtacttcaagctgctgttcgacgagaacaaccacggccagatccggctgagcggcggcgccgagctgttcatgcggcgggccagcctgaagaaggaggagctggtggtgcaccccgccaacagccccatcgccaacaagaaccccgacaaccccaagaagaccaccaccctgagctacgacgtgtacaaggacaagcggttcagcgaggaccagtacgagctgcacatccccatcgccatcaacaagtgccccaagaacatcttcaagatcaacaccgaggtgcgggtgctgctgaagcacgacgacaacccctacgtgatcggcatcgaccggggcgagcggaacctgctgtacatcgtggtggtggacggcaagggcaacatcgtggagcagtacagcctgaacgagatcatcaacaacttcaacggcatccggatcaagaccgactaccacagcctgctggacaagaaggagaaggagcggttcgaggcccggcagaactggaccagcatcgagaacatcaaggagctgaaggccggctacatcagccaggtggtgcacaagatctgcgagctggtggagaagtacgacgccgtgatcgccctggaggacctgaacagcggcttcaagaacagccgggtgaaggtggagaagcaggtgtaccagaagttcgagaagatgctgatcgacaagctgaactacatggtggacaagaaaagcaacccctgcgccaccggcggcgccctgaagggctaccagatcaccaacaagttcgagagcttcaagagcatgagcacccagaacggcttcatcttctacatccccgcctggctgaccagcaagatcgaccccagcaccggcttcgtgaacctgctgaagaccaagtacaccagcatcgccgacagcaagaagttcatcagcagcttcgaccggatcatgtacgtgcccgaggaggacctgttcgagttcgccctggactacaagaacttcagccggaccgacgccgactacatcaagaagtggaagctgtacagctacggcaaccggatccggatcttccggaaccccaagaagaacaacgtgttcgactgggaggaggtgtgcctgaccagcgcctacaaggagctgttcaacaagtacggcatcaactaccagcagggcgacatccgggccctgctgtgcgagcagagcgacaaggccttctacagcagcttcatggccctgatgagcctgatgctgcagatgcggaacagcatcaccggccggaccgacgtggacttcctgatcagccccgtgaagaacagcgacggcatcttctacgacagccggaactacgaggcccaggagaacgccatcctgcccaagaacgccgacgccaacggcgcctacaacatcgcccggaaggtgctgtgggccatcggccagttcaagaaggccgaggacgagaagctggacaaggtgaagatcgccatcagcaacaaggagtggctggagtacgcccagaccagcgtgaagcacaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 1021 - DNA, 3756 bp, Lachnospiraceae bacterium MA2020
atgtactacgagagcctgaccaagcagtaccccgtgagcaagaccatccggaacgagctgatccccatcggcaagaccctggacaacatccggcagaacaacatcctggagagcgacgtgaagcggaagcagaactacgagcacgtgaagggcatcctggacgagtaccacaagcagctgatcaacgaggccctggacaactgcaccctgcccagcctgaagatcgccgccgagatctacctgaagaaccagaaggaggtgagcgaccgggaggacttcaacaagacccaggacctgctgcggaaggaggtggtggagaagctgaaggcccacgagaacttcaccaagatcggcaagaaggacatcctggacctgctggagaagctgcccagcatcagcgaggacgactacaacgccctggagagcttccggaacttctacacctacttcaccagctacaacaaggtgcgggagaacctgtacagcgacaaggagaaaagcagcaccgtggcctaccggctgatcaacgagaacttccccaagttcctggacaacgtgaaaagctaccggttcgtgaagaccgccggcatcctggccgacggcctgggcgaggaggagcaggacagcctgttcatcgtggagaccttcaacaagaccctgacccaggacggcatcgacacctacaacagccaggtgggcaagatcaacagcagcatcaacctgtacaaccagaagaaccagaaggccaacggcttccggaagatccccaagatgaagatgctgtacaagcagatcctgagcgaccgggaggagagcttcatcgacgagttccagagcgacgaggtgctgatcgacaacgtggagagctacggcagcgtgctgatcgagagcctgaaaagcagcaaggtgagcgccttcttcgacgccctgcgggagagcaagggcaagaacgtgtacgtgaagaacgacctggccaagaccgccatgagcaacatcgtgttcgagaactggcggaccttcgacgacctgctgaaccaggagtacgacctggccaacgagaacaagaagaaggacgacaagtacttcgagaagcggcagaaggagctgaagaagaacaagagctacagcctggagcacctgtgcaacctgagcgaggacagctgcaacctgatcgagaactacatccaccagatcagcgacgacatcgagaacatcatcatcaacaacgagaccttcctgcggatcgtgatcaacgagcacgaccggagccggaagctggccaagaaccggaaggccgtgaaggccatcaaggacttcctggacagcatcaaggtgctggagcgggagctgaagctgatcaacagcagcggccaggagctggagaaggacctgatcgtgtacagcgcccacgaggagctgctggtggagctgaagcaggtggacagcctgtacaacatgacccggaactacctgaccaagaagcccttcagcaccgagaaggtgaagctgaacttcaaccggagcaccctgctgaacggctgggaccggaacaaggagaccgacaacctgggcgtgctgctgctgaaggacggcaagtactacctgggcatcatgaacaccagcgccaacaaggccttcgtgaacccccccgtggccaagaccgagaaggtgttcaagaaggtggactacaagctgctgcccgtgcccaaccagatgctgcccaaggtgttcttcgccaagagcaacatcgacttctacaaccccagcagcgagatctacagcaactacaagaagggcacccacaagaagggcaacatgttcagcctggaggactgccacaacctgatcgacttcttcaaggagagcatcagcaagcacgaggactggagcaagttcggcttcaagttcagcgacaccgccagctacaacgacatcagcgagttctaccgggaggtggagaagcagggctacaagctgacctacaccgacatcgacgagacctacatcaacgacctgatcgagcggaacgagctgtacctgttccagatctacaacaaggacttcagcatgtacagcaagggcaagctgaacctgcacaccctgtacttcatgatgctgttcgaccagcggaacatcgacgacgtggtgtacaagctgaacggcgaggccgaggtgttctaccggcccgccagcatcagcgaggacgagctgatcatccacaaggccggcgaggagatcaagaacaagaaccccaaccgggcccggaccaaggagaccagcaccttcagctacgacatcgtgaaggacaagcggtacagcaaggacaagttcaccctgcacatccccatcaccatgaacttcggcgtggacgaggtgaagcggttcaacgacgccgtgaacagcgccatccggatcgacgagaacgtgaacgtgatcggcatcgaccggggcgagcggaacctgctgtacgtggtggtgatcgacagcaagggcaacatcctggagcagatcagcctgaacagcatcatcaacaaggagtacgacatcgagaccgactaccacgccctgctggacgagcgggagggcggccgggacaaggcccggaaggactggaacaccgtggagaacatccgggacctgaaggccggctacctgagccaggtggtgaacgtggtggccaagctggtgctgaagtacaacgccatcatctgcctggaggacctgaacttcggcttcaagcggggccggcagaaggtggagaagcaggtgtaccagaagttcgagaagatgctgatcgacaagctgaactacctggtgatcgacaagagccgggagcagaccagccccaaggagctgggcggcgccctgaacgccctgcagctgaccagcaagttcaagagcttcaaggagctgggcaagcagagcggcgtgatctactacgtgcccgcctacctgaccagcaagatcgaccccaccaccggcttcgccaacctgttctacatgaagtgcgagaacgtggagaaaagcaagcggttcttcgacggcttcgacttcatccggttcaacgccctggagaacgtgttcgagttcggcttcgactaccggagcttcacccagcgggcctgcggcatcaacagcaagtggaccgtgtgcaccaacggcgagcggatcatcaagtaccggaaccccgacaagaacaacatgttcgacgagaaggtggtggtggtgaccgacgagatgaagaacctgttcgagcagtacaagatcccctacgaggacggccggaacgtgaaggacatgatcatcagcaacgaggaggccgagttctaccggcggctgtaccggctgctgcagcagaccctgcagatgcggaacagcaccagcgacggcacccgggactacatcatcagccccgtgaagaacaagcgggaggcctacttcaacagcgagctgagcgacggcagcgtgcccaaggacgccgacgccaacggcgcctacaacatcgcccggaagggcctgtgggtgctggagcagatccggcagaaaagcgagggcgagaagatcaacctggccatgaccaacgccgagtggctggagtacgcccagacccacctgctgaagcggcccgccgccaccaagaaggccggccaggccaagaagaagaagggcagctacccctacgacgtgcccgactacgcctacccctacgacgtgcccgactacgcctacccctacgacgtgcccgactacgcctga

SEQ ID NO: 1022 - RNA, 40 nt, Artificial Sequence
  HBG1-1 full-length gRNA
uaauuucuacucuuguagauccuugucaaggcuauugguc

SEQ ID NO: 1023 - RNA, 41 nt, Artificial Sequence
  HBG1-1 modified full-length gRNA
  misc_feature (40)..(40): Modified to include 2'-O-methyl
  misc_feature (40)..(41): Linked by phosphorodithioate (PS2) bond
  misc_feature (41)..(41): Modified to include 2'-O-methyl
uaauuucuacucuuguagauccuugucaaggcuauugguca

SEQ ID NO: 1024 - RNA, 95 nt, Artificial Sequence
  tSpA dead gRNA
  misc_feature (1)..(1): Modified to contain 2'-O-methyl
  misc_feature (1)..(2): Linked by phosphorothioate (PS) bond
  misc_feature (2)..(3): Linked by phosphorothioate (PS) bond
  misc_feature (2)..(2): Modified to contain 2'-O-methyl
  misc_feature (3)..(4): Linked by phosphorothioate (PS) bond
  misc_feature (3)..(3): Modified to contain 2'-O-methyl
  misc_feature (92)..(93): Linked by phosphorothioate (PS) bond
  misc_feature (92)..(92): Modified to contain 2'-O-methyl
  misc_feature (93)..(94): Linked by phosphorothioate (PS) bond
  misc_feature (93)..(93): Modified to contain 2'-O-methyl
  misc_feature (94)..(95): Linked by phosphorothioate (PS) bond
  misc_feature (94)..(94): Modified to contain 2'-O-methyl
ggcuggccaacccauguuuuagagcuagaaauagcaaguuaaaauaaggcuaguccguuaucaacuugaaaaaguggcaccgagucggugcuuuu

SEQ ID NO: 1025 - RNA, 100 nt, Artificial Sequence; identical to SEQ ID NO: 997
  SpA full-length gRNA
  misc_feature (1)..(1): Modified to contain 2'-O-methyl
  misc_feature (1)..(2): Linked by phosphorothioate (PS) bond
  misc_feature (2)..(2): Modified to contain 2'-O-methyl
  misc_feature (2)..(3): Linked by phosphorothioate (PS) bond
  misc_feature (3)..(3): Modified to contain 2'-O-methyl
  misc_feature (3)..(4): Linked by phosphorothioate (PS) bond
  misc_feature (97)..(97): Modified to contain 2'-O-methyl
  misc_feature (97)..(98): Linked by phosphorothioate (PS) bond
  misc_feature (98)..(98): Modified to contain 2'-O-methyl
  misc_feature (98)..(99): Linked by phosphorothioate (PS) bond
  misc_feature (99)..(100): Linked by phosphorothioate (PS) bond
  misc_feature (99)..(99): Modified to contain 2'-O-methyl

SEQ ID NO: 1026 - RNA, 100 nt, Artificial Sequence
  SpG full-length gRNA
  misc_feature (1)..(1): Modified to contain 2'-O-methyl
  misc_feature (1)..(2): Linked by phosphorothioate (PS) bond
  misc_feature (2)..(2): Modified to contain 2'-O-methyl
  misc_feature (2)..(3): Linked by phosphorothioate (PS) bond
  misc_feature (3)..(3): Modified to contain 2'-O-methyl
  misc_feature (3)..(4): Linked by phosphorothioate (PS) bond
  misc_feature (97)..(97): Modified to contain 2'-O-methyl
  misc_feature (97)..(98): Linked by phosphorothioate (PS) bond
  misc_feature (98)..(98): Modified to contain 2'-O-methyl
  misc_feature (98)..(99): Linked by phosphorothioate (PS) bond
  misc_feature (99)..(100): Linked by phosphorothioate (PS) bond
  misc_feature (99)..(99): Modified to contain 2'-O-methyl
uagucuuagaguauccagugguuuuagagcuagaaauagcaaguuaaaauaaggcuaguccguuaucaacuugaaaaaguggcaccgagucggugcuuuu

SEQ ID NO: 1027 - RNA, 95 nt, Artificial Sequence
  Sp182 dead gRNA
  misc_feature (1)..(1): Modified to contain 2'-O-methyl
  misc_feature (1)..(2): Linked by phosphorothioate (PS) bond
  misc_feature (2)..(3): Linked by phosphorothioate (PS) bond
  misc_feature (2)..(2): Modified to contain 2'-O-methyl
  misc_feature (3)..(4): Linked by phosphorothioate (PS) bond
  misc_feature (3)..(3): Modified to contain 2'-O-methyl
  misc_feature (92)..(93): Linked by phosphorothioate (PS) bond
  misc_feature (92)..(92): Modified to contain 2'-O-methyl
  misc_feature (93)..(94): Linked by phosphorothioate (PS) bond
  misc_feature (93)..(93): Modified to contain 2'-O-methyl
  misc_feature (94)..(95): Linked by phosphorothioate (PS) bond
  misc_feature (94)..(94): Modified to contain 2'-O-methyl
uuagaguauccagugguuuuagagcuagaaauagcaaguuaaaauaaggcuaguccguuaucaacuugaaaaaguggcaccgagucggugcuuuu

SEQ ID NO: 1028 - RNA, 15 nt, Artificial Sequence
  Sp182 dead gRNA targeting domain
uuagaguauccagug

SEQ ID NO: 1029 - DNA, 15 bp, Artificial Sequence
  Sp182 dgRNA targeting domain
ttagagtatccagtg

SEQ ID NO: 1030 - DNA, 20 bp, Artificial Sequence
  SpG gRNA targeting domain
tagtcttagagtatccagtg

SEQ ID NO: 1031 - DNA, 15 bp, Artificial Sequence
  tSpA dead gRNA targeting domain
ggctggccaacccat

SEQ ID NO: 1032 - protein, 1334 aa, Artificial Sequence
  His-AsCpf1-sNLS-sNLS H800A
  MISC_FEATURE (3)..(8): His tag
  MISC_FEATURE (1319)..(1325): sNLS
  MISC_FEATURE (1328)..(1334): sNLS
MGHHHHHHGSTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKVGSPKKKRKV

SEQ ID NO: 1033 - protein, 1384 aa, Artificial Sequence
  SpCas9WT
MKHHHHHHMPKKKRKVMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1034 - protein, 1384 aa, Artificial Sequence
  His-NLS-SpCas9D10A
MKHHHHHHMPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1035 - protein, 1333 aa, Artificial Sequence; identical to SEQ ID NO: 1001
  AsCpf1 His-AsCpf1-NLS-NLS

SEQ ID NO: 1036 - protein, 1332 aa, Artificial Sequence
  AsCpf1 S542R/K607R  (AsCpf1 RR)
MKHHHHHHMPKKKRKVMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNKEKNNGAILFVKNGLYYLGIMPKQKGRYKALSFEPTEKTSEGFDKMYYDYFPDAAKMIPRCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGPKKKRKVG

SEQ ID NO: 1037 - protein, 1332 aa, Artificial Sequence
  AsCpf1 S542R/K548V/N552R (AsCpf1 RVR)
MKHHHHHHMPKKKRKVMTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNVEKNRGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGPKKKRKVG

SEQ ID NO: 1038 - protein, 1334 aa, Artificial Sequence
  His-AsCpf1-2xNLS-S542R/K607R/H800A (AsCpf1 RR-H800A)
MGHHHHHHGSTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNKEKNNGAILFVKNGLYYLGIMPKQKGRYKALSFEPTEKTSEGFDKMYYDYFPDAAKMIPRCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKVGSPKKKRKV

SEQ ID NO: 1039 - protein, 1334 aa, Artificial Sequence
  His-AsCpf1-2xNLS-S542R-K548V-N552R-H800A (Cpf1 RVR H800A)
MGHHHHHHGSTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLARGWDVNVEKNRGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGSPKKKRKVGSPKKKRKV

SEQ ID NO: 1040 - DNA, 100 bp, Artificial Sequence
  Ptx ssODN 18nt - positive strand (OLI16431)
  misc_feature (1)..(2): Linked by phosphorothioate (PS) bond
  misc_feature (99)..(100): Linked by phosphorothioate (PS) bond
ccctggcctcactggatactctaagactattggtcaagtttgccttgtcaaggctggccaacccatgggtggagtttagccagggaccgtttcagacaga

SEQ ID NO: 1041 - RNA, 40 nt, Artificial Sequence; identical to SEQ ID NO: 1022
  gRNA
  misc_feature (39)..(39): Modified to contain 2'-O-methyl
  misc_feature (39)..(40): Linked by phosphorodithioate (PS2) bond
  misc_feature (40)..(40): Modified to contain 2'-O-methyl

SEQ ID NO: 1042 - RNA, 45 nt, Artificial Sequence
  gRNA
cuuuuuaauuucuacucuuguagauccuugucaaggcuauugguc

SEQ ID NO: 1043 - RNA, 50 nt, Artificial Sequence
  gRNA
aagaccuuuuuaauuucuacucuuguagauccuugucaaggcuauugguc

SEQ ID NO: 1044 - RNA, 65 nt, Artificial Sequence
  gRNA
auguguuuuugucaaaagaccuuuuuaauuucuacucuuguagauccuugucaaggcuauugguc

SEQ ID NO: 1045 - RNA, 100 nt, Artificial Sequence
  gRNA
aggccagcuugccgguuuuuuagucgugcugcuucauguguuuuugucaaaagaccuuuuuaauuucuacucuuguagauccuugucaaggcuauugguc

SEQ ID NO: 1046 - DNA, 45 bp, Artificial Sequence
  gRNA
  misc_feature (1)..(5): DNA nucleotides
  misc_feature (6)..(45): RNA nucleotides
cttttuaauuucuacucuuguagauccuugucaaggcuauugguc

SEQ ID NO: 1047 - DNA, 50 bp, Artificial Sequence
  gRNA
  misc_feature (1)..(10): DNA nucleotides
  misc_feature (11)..(50): RNA nucleotides
aagaccttttuaauuucuacucuuguagauccuugucaaggcuauugguc

SEQ ID NO: 1048 - DNA, 65 bp, Artificial Sequence
  gRNA
  misc_feature (1)..(25): DNA nucleotides
  misc_feature (26)..(65): RNA nucleotides
atgtgtttttgtcaaaagaccttttuaauuucuacucuuguagauccuugucaaggcuauugguc

SEQ ID NO: 1049 - DNA, 100 bp, Artificial Sequence
  gRNA
  misc_feature (1)..(60): DNA nucleotides
  misc_feature (61)..(100): RNA nucleotides
aggccagcttgccggttttttagtcgtgctgcttcatgtgtttttgtcaaaagaccttttuaauuucuacucuuguagauccuugucaaggcuauugguc

SEQ ID NO: 1050 - DNA, 66 bp, Artificial Sequence
  gRNA
  misc_feature (1)..(25): DNA nucleotides
  misc_feature (26)..(66): RNA nucleotides
  misc_feature (65)..(65): Modified to contain 2'-O-methyl
  misc_feature (65)..(66): Linked by phosphorodithioate (PS2) bond
  misc_feature (66)..(66): Modified to contain 2'-O-methyl
atgtgtttttgtcaaaagaccttttuaauuucuacucuuguagauccuugucaaggcuauugguca

SEQ ID NO: 1051 - DNA, 66 bp, Artificial Sequence; identical to SEQ ID NO: 1050
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl

SEQ ID NO: 1052 - DNA, 60 bp, Artificial Sequence
  gRNA
  misc_feature (1)..(20): DNA nucleotides
  misc_feature (21)..(60): RNA nucleotides
tttttgtcaaaagaccttttuaauuucuacucuuguagauccuugucaaggcuauugguc

SEQ ID NO: 1053 - DNA, 70 bp, Artificial Sequence
  gRNA
  misc_feature (1)..(30): DNA nucleotides
  misc_feature (31)..(70): RNA nucleotides
gcttcatgtgtttttgtcaaaagaccttttuaauuucuacucuuguagauccuugucaaggcuauugguc

SEQ ID NO: 1054 - DNA, 90 bp, Artificial Sequence
  gRNA
  misc_feature (1)..(50): DNA nucleotides
  misc_feature (51)..(90): RNA nucleotides
gccggttttttagtcgtgctgcttcatgtgtttttgtcaaaagaccttttuaauuucuacucuuguagauccuugucaaggcuauugguc

SEQ ID NO: 1055 - DNA, 80 bp, Artificial Sequence
  gRNA
  misc_feature (1)..(40): DNA nucleotides
  misc_feature (41)..(80): RNA nucleotides
tagtcgtgctgcttcatgtgtttttgtcaaaagaccttttuaauuucuacucuuguagauccuugucaaggcuauugguc

SEQ ID NO: 1056 - DNA, 60 bp, Artificial Sequence
  gRNA
  misc_feature (1)..(20): DNA nucleotides
  misc_feature (1)..(2): Linked by phosphorothioate (PS) bond
  misc_feature (2)..(3): Linked by phosphorothioate (PS) bond
  misc_feature (21)..(60): RNA nucleotides
ccgaagttttcttcggttttuaauuucuacucuuguagauccuugucaaggcuauugguc

SEQ ID NO: 1057 - DNA, 65 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(65): RNA nucleotides
tttttccgaagttttcttcggttttuaauuucuacucuuguagauccuugucaaggcuauugguc

SEQ ID NO: 1058 - DNA, 70 bp, Artificial Sequence
  gRNA
  misc_feature (1)..(30): DNA nucleotides
  misc_feature (1)..(2): Linked by phosphorothioate (PS) bond
  misc_feature (2)..(3): Linked by phosphorothioate (PS) bond
  misc_feature (31)..(70): RNA nucleotides
aacgctttttccgaagttttcttcggttttuaauuucuacucuuguagauccuugucaaggcuauugguc

SEQ ID NO: 1059 - DNA, 81 bp, Artificial Sequence
  gRNA
  misc_feature (1)..(41): DNA nucleotides
  misc_feature (1)..(2): Linked by phosphorothioate (PS) bond
  misc_feature (2)..(3): Linked by phosphorothioate (PS) bond
  misc_feature (42)..(81): RNA nucleotides
gcgttgttttcaacgctttttccgaagttttcttcggttttuaauuucuacucuuguagauccuugucaaggcuauugguc

SEQ ID NO: 1060 - DNA, 102 bp, Artificial Sequence
  gRNA
  misc_feature (1)..(62): DNA nucleotides
  misc_feature (1)..(2): Linked by phosphorothioate (PS) bond
  misc_feature (2)..(3): Linked by phosphorothioate (PS) bond
  misc_feature (63)..(102): RNA nucleotides
ggcttcttttgaagcctttttgcgttgttttcaacgctttttccgaagttttcttcggttttuaauuucuacucuuguagauccuugucaaggcuauugguc

SEQ ID NO: 1061 - RNA, 40 nt, Artificial Sequence; identical to SEQ ID NO: 1022
  gRNA
  misc_feature (1)..(1): Modified to contain 2'-O-methyl

SEQ ID NO: 1062 - RNA, 40 nt, Artificial Sequence; identical to SEQ ID NO: 1022
  gRNA
  misc_feature (1)..(1): Modified to contain 2'-O-methyl
  misc_feature (1)..(2): Linked by phosphorothioate (PS) bond

SEQ ID NO: 1063 - RNA, 40 nt, Artificial Sequence; identical to SEQ ID NO: 1022
  gRNA
  misc_feature (1)..(1): Modified to contain 2'-O-methyl
  misc_feature (2)..(2): Modified to contain 2'-O-methyl

SEQ ID NO: 1064 - RNA, 40 nt, Artificial Sequence; identical to SEQ ID NO: 1022
  gRNA
  misc_feature (1)..(1): Modified to contain 2'-O-methyl
  misc_feature (1)..(2): Linked by phosphorothioate (PS) bond
  misc_feature (2)..(2): Modified to contain 2'-O-methyl

SEQ ID NO: 1065 - RNA, 40 nt, Artificial Sequence; identical to SEQ ID NO: 1022
  gRNA
  misc_feature (1)..(1): Modified to contain 2'-O-methyl
  misc_feature (2)..(2): Modified to contain 2'-O-methyl
  misc_feature (3)..(3): Modified to contain 2'-O-methyl

SEQ ID NO: 1066 - RNA, 40 nt, Artificial Sequence; identical to SEQ ID NO: 1022
  gRNA
  misc_feature (1)..(1): Modified to contain 2'-O-methyl
  misc_feature (1)..(2): Linked by phosphorothioate (PS) bond
  misc_feature (2)..(3): Linked by phosphorothioate (PS) bond
  misc_feature (2)..(2): Modified to contain 2'-O-methyl
  misc_feature (3)..(4): Linked by phosphorothioate (PS) bond
  misc_feature (3)..(3): Modified to contain 2'-O-methyl

SEQ ID NO: 1067 - DNA, 65 bp, Artificial Sequence; identical to SEQ ID NO: 1048
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(65): RNA nucleotides

SEQ ID NO: 1068 - DNA, 66 bp, Artificial Sequence; identical to SEQ ID NO: 1050
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(66): RNA nucleotides
  misc_feature (65)..(66): Linked by phosphorothioate (PS) bond
  misc_feature (66)..(66): Modified to contain 2'-O-methyl

SEQ ID NO: 1069 - RNA, 41 nt, Artificial Sequence; identical to SEQ ID NO: 1023
  gRNA
  misc_feature (40)..(41): Linked by phosphorothioate (PS) bond
  misc_feature (41)..(41): Modified to contain 2'-O-methyl

SEQ ID NO: 1070 - RNA, 42 nt, Artificial Sequence
  gRNA
  misc_feature (41)..(41): Modified to contain 2'-O-methyl
  misc_feature (41)..(42): Linked by phosphorothioate (PS) bond
uaauuucuacucuuguagauccuugucaaggcuauuggucau

SEQ ID NO: 1071 - RNA, 41 nt, Artificial Sequence
  gRNA
uaauuucuacucuuguagauccuugucaaggcuauuggucu

SEQ ID NO: 1072 - RNA, 42 nt, Artificial Sequence; identical to SEQ ID NO: 1070
  gRNA

SEQ ID NO: 1073 - RNA, 44 nt, Artificial Sequence
  gRNA
uaauuucuacucuuguagauccuugucaaggcuauuggucaagu

SEQ ID NO: 1074 - DNA, 66 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(66): RNA nucleotides
atgtgtttttgtcaaaagaccttttuaauuucuacucuuguagauccuugucaaggcuauuggucu

SEQ ID NO: 1075 - DNA, 69 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(69): RNA nucleotides
atgtgtttttgtcaaaagaccttttuaauuucuacucuuguagauccuugucaaggcuauuggucaagu

SEQ ID NO: 1076 - RNA, 41 nt, Artificial Sequence; identical to SEQ ID NO: 1023
  gRNA

SEQ ID NO: 1077 - RNA, 43 nt, Artificial Sequence
  gRNA
uaauuucuacucuuguagauccuugucaaggcuauuggucaag

SEQ ID NO: 1078 - DNA, 68 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(68): RNA nucleotides
atgtgtttttgtcaaaagaccttttuaauuucuacucuuguagauccuugucaaggcuauuggucaag

SEQ ID NO: 1079 - RNA, 44 nt, Artificial Sequence
  gRNA
uaauuucuacucuuguagauccuugucaaggcuauuggucuuuu

SEQ ID NO: 1080 - RNA, 44 nt, Artificial Sequence; identical to SEQ ID NO: 1079
  gRNA
  misc_feature (41)..(41): Modified to contain 2'-O-methyl
  misc_feature (41)..(42): Linked by phosphorothioate (PS) bond
  misc_feature (42)..(43): Linked by phosphorothioate (PS) bond
  misc_feature (42)..(42): Modified to contain 2'-O-methyl
  misc_feature (43)..(43): Modified to contain 2'-O-methyl
  misc_feature (43)..(44): Linked by phosphorothioate (PS) bond

SEQ ID NO: 1081 - DNA, 69 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(69): RNA nucleotides
atgtgtttttgtcaaaagaccttttuaauuucuacucuuguagauccuugucaaggcuauuggucuuuu

SEQ ID NO: 1082 - DNA, 66 bp, Artificial Sequence
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl
aaaaaaaaaaaaaaaaaaaaaaaaauaauuucuacucuuguagauccuugucaaggcuauugguca

SEQ ID NO: 1083 - DNA, 66 bp, Artificial Sequence
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl
tttttttttttttttttttttttttuaauuucuacucuuguagauccuugucaaggcuauugguca

SEQ ID NO: 1084 - DNA, 61 bp, Artificial Sequence
  gRNA
  misc_feature (1)..(20): DNA nucleotides
  misc_feature (1)..(2): Linked by phosphorothioate (PS) bond
  misc_feature (2)..(3): Linked by phosphorothioate (PS) bond
  misc_feature (21)..(61): RNA nucleotides
  misc_feature (60)..(61): Linked by phosphorothioate (PS) bond
  misc_feature (61)..(61): Modified to contain 2'-O-methyl
ccgaagttttcttcggttttuaauuucuacucuuguagauccuugucaaggcuauugguca

SEQ ID NO: 1085 - RNA, 41 nt, Artificial Sequence
  gRNA
  misc_feature (40)..(41): Linked by phosphorothioate (PS) bond
  misc_feature (41)..(41): Modified to contain 2'-O-methyl
uaauuucuacucuuguagauagacagauauuugcauugaga

SEQ ID NO: 1086 - DNA, 66 bp, Artificial Sequence
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl
atgtgtttttgtcaaaagaccttttuaauuucuacucuuguagauagacagauauuugcauugaga

SEQ ID NO: 1087 - DNA, 61 bp, Artificial Sequence
  gRNA
  misc_feature (1)..(20): DNA nucleotides
  misc_feature (1)..(2): Linked by phosphorothioate (PS) bond
  misc_feature (2)..(3): Linked by phosphorothioate (PS) bond
  misc_feature (21)..(61): RNA nucleotides
  misc_feature (60)..(61): Linked by phosphorothioate (PS) bond
  misc_feature (61)..(61): Modified to contain 2'-O-methyl
ccgaagttttcttcggttttuaauuucuacucuuguagauagacagauauuugcauugaga

SEQ ID NO: 1088 - RNA, 41 nt, Artificial Sequence
  gRNA
  misc_feature (40)..(41): Linked by phosphorothioate (PS) bond
  misc_feature (41)..(41): Modified to contain 2'-O-methyl
uaauuucuacucuuguagaucauugagauaguguggggaag

SEQ ID NO: 1089 - DNA, 66 bp, Artificial Sequence
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl
atgtgtttttgtcaaaagaccttttuaauuucuacucuuguagaucauugagauaguguggggaag

SEQ ID NO: 1090 - DNA, 61 bp, Artificial Sequence
  gRNA
  misc_feature (1)..(20): DNA nucleotides
  misc_feature (1)..(2): Linked by phosphorothioate (PS) bond
  misc_feature (2)..(3): Linked by phosphorothioate (PS) bond
  misc_feature (21)..(61): RNA nucleotides
  misc_feature (60)..(61): Linked by phosphorothioate (PS) bond
  misc_feature (61)..(61): Modified to contain 2'-O-methyl
ccgaagttttcttcggttttuaauuucuacucuuguagaucauugagauaguguggggaag

SEQ ID NO: 1091 - RNA, 41 nt, Artificial Sequence
  gRNA
  misc_feature (40)..(41): Linked by phosphorothioate (PS) bond
  misc_feature (41)..(41): Modified to contain 2'-O-methyl
uaauuucuacucuuguagaucuucucccaucauagaggaua

SEQ ID NO: 1092 - DNA, 66 bp, Artificial Sequence
  gRNA
  misc_feature (1)..(25): DNA nucleotides
  misc_feature (26)..(66): RNA nucleotides
  misc_feature (65)..(66): Linked by phosphorothioate (PS) bond
  misc_feature (66)..(66): Modified to contain 2'-O-methyl
atgtgtttttgtcaaaagaccttttuaauuucuacucuuguagaucuucucccaucauagaggaua

SEQ ID NO: 1093 - DNA, 61 bp, Artificial Sequence
  gRNA
  misc_feature (1)..(20): DNA nucleotides
  misc_feature (1)..(2): Linked by phosphorothioate (PS) bond
  misc_feature (2)..(3): Linked by phosphorothioate (PS) bond
  misc_feature (21)..(61): RNA nucleotides
  misc_feature (60)..(61): Linked by phosphorothioate (PS) bond
  misc_feature (61)..(61): Modified to contain 2'-O-methyl
ccgaagttttcttcggttttuaauuucuacucuuguagaucuucucccaucauagaggaua

SEQ ID NO: 1094 - protein, 1363 aa, Artificial Sequence
  Cpf1
  MISC_FEATURE (1310)..(1331): NLS
  MISC_FEATURE (1358)..(1363): His tag
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 1095 - protein, 1363 aa, Artificial Sequence
  Cpf1
  MISC_FEATURE (1310)..(1331): NLS
  MISC_FEATURE (1358)..(1363): His tag
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 1096 - protein, 1363 aa, Artificial Sequence
  Cpf1
  MISC_FEATURE (1310)..(1331): NLS
  MISC_FEATURE (1358)..(1363): His tag
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 1097 - protein, 1331 aa, Artificial Sequence
  Cpf1
  MISC_FEATURE (1310)..(1331): NLS
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAARLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKV

SEQ ID NO: 1098 - DNA, 67 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(67): RNA nucleotides
  misc_feature (66)..(67): Linked by phosphorothioate (PS) bond
  misc_feature (66)..(66): Modified to contain 2'-O-methyl
atgtgtttttgtcaaaagaccttttuaauuucuacucuuguagauccuugucaaggcuauuggucau

SEQ ID NO: 1099 - DNA, 68 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(68): RNA nucleotides
  misc_feature (66)..(67): Linked by phosphorothioate (PS) bond
  misc_feature (66)..(66): Modified to contain 2'-O-methyl
  misc_feature (67)..(67): Modified to contain 2'-O-methyl
  misc_feature (67)..(68): Linked by phosphorothioate (PS) bond
atgtgtttttgtcaaaagaccttttuaauuucuacucuuguagauccuugucaaggcuauuggucaau

SEQ ID NO: 1100 - DNA, 66 bp, Artificial Sequence; identical to SEQ ID NO: 1074
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(66): RNA nucleotides
  misc_feature (65)..(65): Modified to contain 2'-O-methyl
  misc_feature (65)..(66): Linked by phosphorothioate (PS) bond

SEQ ID NO: 1101 - DNA, 65 bp, Artificial Sequence; identical to SEQ ID NO: 1048
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(65): RNA nucleotides
  misc_feature (64)..(65): Linked by phosphorothioate (PS) bond
  misc_feature (65)..(65): Modified to contain 2'-O-methyl

SEQ ID NO: 1102 - DNA, 67 bp, Artificial Sequence
  gRNA
  misc_feature (1)..(25): DNA nucleotides
  misc_feature (1)..(2): Linked by phosphorothioate (PS) bond
  misc_feature (2)..(3): Linked by phosphorothioate (PS) bond
  misc_feature (26)..(67): RNA nucleotides
  misc_feature (65)..(66): Linked by phosphorothioate (PS) bond
  misc_feature (66)..(67): Linked by phosphorothioate (PS) bond
  misc_feature (66)..(66): Modified to contain 2'-O-methyl
  misc_feature (67)..(67): Modified to contain 2'-O-methyl
atgtgtttttgtcaaaagaccttttuaauuucuacucuuguagauccuugucaaggcuauuggucaa

SEQ ID NO: 1103 - RNA, 66 nt, Artificial Sequence
  gRNA
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
  misc_feature (65)..(66): Linked by phosphorothioate (PS) bond
  misc_feature (66)..(66): Modified to contain 2'-O-methyl
auguguuuuugucaaaagaccuuuuuaauuucuacucuuguagauccuugucaaggcuauugguca

SEQ ID NO: 1104 - RNA, 66 nt, Artificial Sequence
  gRNA
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
  misc_feature (65)..(66): Linked by phosphorothioate (PS) bond
  misc_feature (66)..(66): Modified to contain 2'-O-methyl
aaaaaaaaaaaaaaaaaaaaaaaaauaauuucuacucuuguagauccuugucaaggcuauugguca

SEQ ID NO: 1105 - RNA, 66 nt, Artificial Sequence
  gRNA
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
  misc_feature (65)..(66): Linked by phosphorothioate (PS) bond
  misc_feature (66)..(66): Modified to contain 2'-O-methyl
uuuuuuuuuuuuuuuuuuuuuuuuuuaauuucuacucuuguagauccuugucaaggcuauugguca

SEQ ID NO: 1106 - DNA, 42 bp, Artificial Sequence
  gRNA
  misc_feature (1)..(2): Linked by phosphorothioate (PS) bond
  misc_feature (2)..(3): Linked by phosphorothioate (PS) bond
uaauuucuacucuuguagauccuugucaggcuauuggtcaag

SEQ ID NO: 1107 - protein, 1331 aa, Artificial Sequence
  Cpf1
  MISC_FEATURE (1310)..(1331): NLS
STQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKV

SEQ ID NO: 1108 - protein, 1363 aa, Artificial Sequence
  Cpf1
  MISC_FEATURE (1310)..(1331): NLS
  MISC_FEATURE (1358)..(1363): His tag
STQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 1109 - protein, 1361 aa, Artificial Sequence
  Cpf1
  MISC_FEATURE (1342)..(1348): NLS
  MISC_FEATURE (1356)..(1361): His tag
MGRDPGKPIPNPLLGLDSTAPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNPKKKRKVKLAAALEHHHHHH

SEQ ID NO: 1110 - DNA, 4002 bp, Artificial Sequence
  His-AsCpf1-sNLS-sNLS H800A
  misc_feature (7)..(24): His tag
  misc_feature (3955)..(3975): sNLS
  misc_feature (3982)..(4002): sNLS
atgggccatcatcatcaccatcacggtagcacccagtttgaaggctttaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacgtacgcagatcagtgtctgcagctggttcagctggattgggaaaatctgagcgcagcaattgatagttatcgcaaagagaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacacagattgatctgtataaccagctgttaggtggtattagccgtgaagcaggcaccgaaaaaatcaaaggtctgaatgaagtgctgaatctggccattcagaaaaatgatgaaaccgcacatattattgcaagcctgccgcatcgttttattccgctgtttaagcagattctgagcgatcgtaataccctgagctttattctggaagaattcaaatccgatgaagaggtgattcagagcttctgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgagccatgcacatgcagcactggatcagccgctgccgaccacactgaaaaaacaagaagaaaaagagatcctgaaaagccagctggatagcctgctgggtctgtatcatctgctggactggtttgcagttgatgaaagcaatgaagttgatccggaatttagcgcacgtctgaccggcattaagctggaaatggaaccgagcctgagtttttacaataaagcccgtaattatgccaccaaaaaaccgtatagcgtggaaaaattcaagctgaacttccagatgccgacactggcaagcggttgggatgttaataaagaaaagaacaatggtgccatcctgttcgtgaaaaatggcctgtattatctgggtatcatgccgaaacagaaaggtcgttataaagcactgagctttgaaccgacagaaaaaaccagtgaaggcttcgataaaatgtactatgattactttccggacgcagccaaaatgattccgaaatgcagcacccagctgaaagcagttaccgcacattttcagacccataccacaccgattctgctgagcaataactttattgaaccgctggaaatcaccaaagagatctacgatctgaataacccggaaaaagagccgaaaaagtttcagaccgcctatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaataatggatgcagttgaaaccggtaagctgtacctgttccagatttataacaaagactttgccaaaggccatcatggtaaaccgaatctgcataccctgtattggaccggtctgtttagccctgaaaatctggcaaaaaccagcattaaactgaatggtcaggcggaactgttttatcgtccgaaaagccgtatgaaacgtatggcagcacgtctgggtgaaaaaatgctgaataaaaagctgaaggatcagaaaaccccgattccggatacactgtatcaagagctgtatgattatgtgaatcatcgtctgagtcatgatctgagtgatgaagcacgtgccctgctgccgaatgttattaccaaagaagttagccacgagatcattaaagatcgtcgttttaccagcgacaagttttttttccatgttccgattacgctgaattatcaggcagcaaatagcccgagcaaatttaaccagcgtgtgaatgcatatctgaaagaacatccggaaacaccgattattggtattgatcgtggtgaacgcaacctgatttatatcaccgttattgatagcaccggcaagatcctggaacagcgtagcctgaataccattcagcagtttgattatcagaaaaagctggacaaccgtgaaaaagaacgtgttgcagcccgtcaggcatggtcagttgttggtacaattaaagacctgaaacagggttatctgagccaggttattcatgaaattgtggatctgatgattcattaccaggcagttgttgtgctggaaaacctgaattttggctttaaaagcaaacgtaccggcattgcggaaaaagcagtttatcagcagttcgaaaagatgctgatcgataaactgaactgtctggtgctgaaagattatccggctgaaaaagttggcggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggttttgatttcctgcattacgacgttaagaccggtgattttattctgcactttaagatgaatcggaacctgtcatttcagcgtggtctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgttagagaatgatgatagccatgccattgataccatggttgccctgattcgtagcgttctgcagatgcgtaatagcaatgcagcaaccggtgaagattacattaatagtccggttcgtgatctgaatggtgtttgttttgatagccgttttcagaatccggaatggccgatggatgcggatgcaaatggtgcatatcatattgcactgaaaggacagctgctgctgaaccacctgaaagaaagtaaagatttgaagctgcagaatggcattagcaatcaggattggctggcatatatccaagaactgcgtaacggttctcctaagaaaaagcgcaaagttggcagtccgaagaagaaacgtaaggtt

SEQ ID NO: 1111 - DNA, 4089 bp, Artificial Sequence
  Cpf1
  misc_feature (3928)..(3993): NLS
  misc_feature (4072)..(4089): His tag
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 1112 - DNA, 4089 bp, Artificial Sequence
  Cpf1
  misc_feature (3928)..(3993): NLS
  misc_feature (4072)..(4089): His tag
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 1113 - DNA, 4089 bp, Artificial Sequence
  Cpf1
  misc_feature (3928)..(3993): NLS
  misc_feature (4072)..(4089): His tag
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcagctcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 1114 - DNA, 3993 bp, Artificial Sequence
  Cpf1
  misc_feature (3928)..(3993): NLS
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcagctcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagtt

SEQ ID NO: 1115 - DNA, 3993 bp, Artificial Sequence
  Cpf1
  misc_feature (3928)..(3993): NLS
agcacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagtt

SEQ ID NO: 1116 - DNA, 4089 bp, Artificial Sequence
  Cpf1
  misc_feature (3928)..(3993): NLS
  misc_feature (4072)..(4089): His tag
agcacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 1117 - DNA, 4083 bp, Artificial Sequence
  Cpf1
  misc_feature (4024)..(4044): NLS
  misc_feature (4066)..(4083): His tag
atgggtcgggatccaggtaaaccgattccgaatccgctgctgggtctggatagcaccgcaccgaaaaaaaaacgtaaagttggtattcatggtgttccggcagcaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaaccctaaaaaaaaacgcaaagtgaagcttgcggccgcactcgagcaccaccaccaccaccac

SEQ ID NO: 1118 - DNA, 304 bp, Homo sapiens
tcctaaagcttggaacactttcccttccttaagaaccatccttgctactcagctgcaatcaatccagcccccaggtcttcactgaaccttttcccatctcttccaaaacatctgtttctgagaagtcctgtcctatagaggtctttcttcccaccggatttctcctacaccatttactcccacttgcagaactcccgtgtacaagtgtctttactgcttttatttgctcatcaaaatgcacatctcatataaaaataaatgaggagcatgcacacaccacaaacacaaacaggcatgcagaaat

SEQ ID NO: 1119 - DNA, 665 bp, Homo sapiens
ataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatct

SEQ ID NO: 1120 - DNA, 165 bp, Homo sapiens
ccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctgga

SEQ ID NO: 1121 - DNA, 122 bp, Homo sapiens
ctgtgagattgacaagaacagtttgacagtcagaaggtgccacaaatcctgagaagcgacctggacttttgccaggcacagggtccttccttccctcccttgtcctggtcaccagagcctac

SEQ ID NO: 1122 - DNA, 24 bp, Homo sapiens
gccgccggcccctggcctcactgg

SEQ ID NO: 1123 - DNA, 33 bp, Homo sapiens
ccttgtcaaggctattggtcaaggcaaggctgg

SEQ ID NO: 1124 - DNA, 36 bp, Homo sapiens
tgagatagtgtggggaaggggcccccaagaggatac

SEQ ID NO: 1125 - DNA, 41 bp, Homo sapiens
tatagcctttgccttgttccgattcagtcattccagttttt

SEQ ID NO: 1126 - DNA, 114 bp, Homo sapiens
tcttccctttagctagtttccttctcccatcatagaggataccaggacttcttttgtcagccgttttttaccttcttgtctctagctccagtgaggcctgtagtttaaagctaa

SEQ ID NO: 1127 - DNA, 86 bp, Homo sapiens
ccacagtttcagcgcagtaatagattagtgttacataatataagacctaatgcttacctcaatatctacttatccgtacctatttg

SEQ ID NO: 1128 - DNA, 142 bp, Homo sapiens
tattcaggtatgtatgtatacaccagatgatgtgtatttaccactggataagtgtgtgtgctggctgatgacccagggttttggcgtagctcttctatgctcagtaaagatgatggtagaatgttctttggcaggtactgtg

SEQ ID NO: 1129 - DNA, 697 bp, Homo sapiens
caataaagatgaacccatagtgagctgagagctccagcctggcctccagataactacacaccaagcttccacccagaatcaagcctatgttaacttccctcaaagcctgagattttgctttcccattaaatgcaggtagttgttcttcttgcagcactagtcactggccataatttaaatcttgttatcttcttgccaccatgaaccctgtatgctgtaggctgaaaacgttaaaagaaacacacgctctcacacacacacaaacacacgcgcgcacacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaatgaccatacttgtcctgcctccagatagatgttttaaaacgaataacaaaaataggggaaaggtgaaagttctttctaccgaaatctaataaagaaaagtcattttcctcatttccacctctcttttctcaaagtcaaagttgtccatctagattttcagaggcactccttagg

SEQ ID NO: 1130 - DNA, 185 bp, Homo sapiens
ccctaaaacattgccactgggtctcagcccagttagtcctctgcagtttcttcactcccaaccccagtatcttcaaacagctcacaccctgctgtgctcagatcaatactcagttgtctaagttgcctcgagactaaaggcaacagtgctgaaacatctcctggactcaccttgaagttctcagg

SEQ ID NO: 1131 - DNA, 137 bp, Homo sapiens
agcctgtgagattgacaagaacagtttgacagtcagaaggtgccacaaatcctgagaagcgacctggacttttgccaggcacagggtccttccttccctcccttgtcctggtcaccagagcctaccttcccagggtt

SEQ ID NO: 1132 - DNA, 38 bp, Homo sapiens
ccgccggcccctggcctcactggatactctaagactat

SEQ ID NO: 1133 - DNA, 31 bp, Homo sapiens
ccttgtcaaggctattggtcaaggcaaggct

SEQ ID NO: 1134 - DNA, 75 bp, Homo sapiens
cagggaccgtttcagacagatatttgcattgagatagtgtggggaaggggcccccaagaggatactgctgcttaa

SEQ ID NO: 1135 - DNA, 29 bp, Homo sapiens
ttgccttgttccgattcagtcattccaat

SEQ ID NO: 1136 - DNA, 104 bp, Homo sapiens
tttagctagttttcttctcccaccatagaagataccaggacttcttttgtcagccgtttttcaccttcttgtctgtagctccagtgaggcctgtagtttaaagt

SEQ ID NO: 1137 - DNA, 38 bp, Homo sapiens
ggacacgtcttagtctcatttagtaagcattggtttcc

SEQ ID NO: 1138 - DNA, 124 bp, Homo sapiens
ttttttatattcaggtatgtatgtaggcacccgatgatgtgtatttatcactggataagtgtatgtgctggctgatgacccagggttttggtgtagctcttctatgctcggtaaagatgatggt

SEQ ID NO: 1139 - RNA, 20 nt, Artificial Sequence
  gRNA targeting domain - AsCpf1 HBG1 Promoter-1
agacagauauuugcauugag

SEQ ID NO: 1140 - DNA, 20 bp, Artificial Sequence
  gRNA targeting domain - AsCpf1 HBG1 Promoter-1
agacagatatttgcattgag

SEQ ID NO: 1141 - RNA, 20 nt, Artificial Sequence
  gRNA targeting domain - AsCpf1 HBG1 Promoter-2
cauugagauaguguggggaa

SEQ ID NO: 1142 - DNA, 20 bp, Artificial Sequence
  gRNA targeting domain - AsCpf1 HBG1 Promoter-2
cattgagatagtgtggggaa

SEQ ID NO: 1143 - RNA, 20 nt, Artificial Sequence
  gRNA targeting domain - AsCpf1 HBG1 Promoter-3
uagccuuugccuuguuccga

SEQ ID NO: 1144 - DNA, 20 bp, Artificial Sequence
  gRNA targeting domain - AsCpf1 HBG1 Promoter-3
tagcctttgccttgttccga

SEQ ID NO: 1145 - RNA, 20 nt, Artificial Sequence
  gRNA targeting domain - AsCpf1 HBG1 Promoter-4
ccuuguuccgauucagucau

SEQ ID NO: 1146 - DNA, 20 bp, Artificial Sequence
  gRNA targeting domain - AsCpf1 HBG1 Promoter-4
ccttgttccgattcagtcat

SEQ ID NO: 1147 - RNA, 20 nt, Artificial Sequence
  gRNA targeting domain - AsCpf1 HBG1 Promoter-5
ucuaauuuauucuucccuuu

SEQ ID NO: 1148 - DNA, 20 bp, Artificial Sequence
  gRNA targeting domain - AsCpf1 HBG1 Promoter-5
tctaatttattcttcccttt

SEQ ID NO: 1149 - RNA, 20 nt, Artificial Sequence
  gRNA targeting domain - AsCpf1 HBG1 Promoter-6
cuucucccaucauagaggau

SEQ ID NO: 1150 - DNA, 20 bp, Artificial Sequence
  gRNA targeting domain - AsCpf1 HBG1 Promoter-6
cttctcccatcatagaggat

SEQ ID NO: 1151 - RNA, 20 nt, Artificial Sequence
  gRNA targeting domain - AsCpf1 HBG2 Promoter-7
uucucccaccauagaagaua

SEQ ID NO: 1152 - DNA, 20 bp, Artificial Sequence
  gRNA targeting domain - AsCpf1 HBG2 Promoter-7
ttctcccaccatagaagata

SEQ ID NO: 1153 - RNA, 20 nt, Artificial Sequence
  gRNA targeting domain - AsCpf1 HBG1 Promoter-8
ccacuggauaagugugugug

SEQ ID NO: 1154 - DNA, 20 bp, Artificial Sequence
  gRNA targeting domain - AsCpf1 HBG1 Promoter-8
ccactggataagtgtgtgtg

SEQ ID NO: 1155 - RNA, 20 nt, Artificial Sequence
  gRNA targeting domain - AsCpf1 HBG1 Promoter-9
gcguagcucuucuaugcuca

SEQ ID NO: 1156 - DNA, 20 bp, Artificial Sequence
  gRNA targeting domain - AsCpf1 HBG1 Promoter-9
gcgtagctcttctatgctca

SEQ ID NO: 1157 - RNA, 20 nt, Artificial Sequence
  gRNA targeting domain - AsCpf1 HBG1 Promoter-10
cugagcauagaagagcuacg

SEQ ID NO: 1158 - DNA, 20 bp, Artificial Sequence
  gRNA targeting domain - AsCpf1 HBG1 Promoter-10
ctgagcatagaagagctacg

SEQ ID NO: 1159 - RNA, 20 nt, Artificial Sequence
  gRNA targeting domain - AsCpf1 HBG2 Promoter-11
ucacuggauaaguguaugug

SEQ ID NO: 1160 - DNA, 20 bp, Artificial Sequence
  gRNA targeting domain - AsCpf1 HBG2 Promoter-11
tcactggataagtgtatgtg

SEQ ID NO: 1161 - RNA, 20 nt, Artificial Sequence
  gRNA targeting domain - AsCpf1 HBG2 Promoter-12
guguagcucuucuaugcucg

SEQ ID NO: 1162 - DNA, 20 bp, Artificial Sequence
  gRNA targeting domain - AsCpf1 HBG2 Promoter-12
gtgtagctcttctatgctcg

SEQ ID NO: 1163 - RNA, 20 nt, Artificial Sequence
  gRNA targeting domain - AsCpf1 HBG2 Promoter-13
ccgagcauagaagagcuaca

SEQ ID NO: 1164 - DNA, 20 bp, Artificial Sequence
  gRNA targeting domain - AsCpf1 HBG2 Promoter-13
ccgagcatagaagagctaca

SEQ ID NO: 1165-1166 - skipped (2 entries)

SEQ ID NO: 1167 - RNA, 20 nt, Artificial Sequence
  gRNA targeting domain - AsCpf1 RR HBG1 Promoter-1
gacagauauuugcauugaga

SEQ ID NO: 1168 - DNA, 20 bp, Artificial Sequence
  gRNA targeting domain - AsCpf1 RR HBG1 Promoter-1
gacagatatttgcattgaga

SEQ ID NO: 1169 - RNA, 20 nt, Artificial Sequence
  gRNA targeting domain - AsCpf1 RR HBG1 Promoter-2
acacuaucucaaugcaaaua

SEQ ID NO: 1170 - DNA, 20 bp, Artificial Sequence
  gRNA targeting domain - AsCpf1 RR HBG1 Promoter-2
acactatctcaatgcaaata

SEQ ID NO: 1171 - RNA, 20 nt, Artificial Sequence
  gRNA targeting domain - AsCpf1 RR HBG1 Promoter-3
cacacuaucucaaugcaaau

SEQ ID NO: 1172 - DNA, 20 bp, Artificial Sequence
  gRNA targeting domain - AsCpf1 RR HBG1 Promoter-3
cacactatctcaatgcaaat

SEQ ID NO: 1173 - RNA, 20 nt, Artificial Sequence
  gRNA targeting domain - AsCpf1 RR HBG1 Promoter-4
ccacacuaucucaaugcaaa

SEQ ID NO: 1174 - DNA, 20 bp, Artificial Sequence
  gRNA targeting domain - AsCpf1 RR HBG1 Promoter-4
ccacactatctcaatgcaaa

SEQ ID NO: 1175 - RNA, 20 nt, Artificial Sequence
  gRNA targeting domain - AsCpf1 RR HBG1 Promoter-5
uuccccacacuaucucaaug

SEQ ID NO: 1176 - DNA, 20 bp, Artificial Sequence
  gRNA targeting domain - AsCpf1 RR HBG1 Promoter-5
ttccccacactatctcaatg

SEQ ID NO: 1177 - RNA, 20 nt, Artificial Sequence
  gRNA targeting domain - AsCpf1 RR HBG1 Promoter-6
gauucagucauuccaguuuu

SEQ ID NO: 1178 - DNA, 20 bp, Artificial Sequence
  gRNA targeting domain - AsCpf1 RR HBG1 Promoter-6
gattcagtcattccagtttt

SEQ ID NO: 1179 - RNA, 20 nt, Artificial Sequence
  gRNA targeting domain - AsCpf1 RR HBG1 Promoter-7
auucagucauuccaguuuuu

SEQ ID NO: 1180 - DNA, 20 bp, Artificial Sequence
  gRNA targeting domain - AsCpf1 RR HBG1 Promoter-7
attcagtcattccagttttt

SEQ ID NO: 1181 - RNA, 20 nt, Artificial Sequence
  gRNA targeting domain - AsCpf1 RR HBG1 Promoter-8
gucauuccaguuuuucucua

SEQ ID NO: 1182 - DNA, 20 bp, Artificial Sequence
  gRNA targeting domain - AsCpf1 RR HBG1 Promoter-8
gtcattccagtttttctcta

SEQ ID NO: 1183 - RNA, 20 nt, Artificial Sequence
  gRNA targeting domain - AsCpf1 RR HBG1 Promoter-9
aguuuuucucuaauuuauuc

SEQ ID NO: 1184 - DNA, 20 bp, Artificial Sequence
  gRNA targeting domain - AsCpf1 RR HBG1 Promoter-9
agtttttctctaatttattc

SEQ ID NO: 1185 - RNA, 20 nt, Artificial Sequence
  gRNA targeting domain - AsCpf1 RR HBG1 Promoter-10
guuuuucucuaauuuauucu

SEQ ID NO: 1186 - DNA, 20 bp, Artificial Sequence
  gRNA targeting domain - AsCpf1 RR HBG1 Promoter-10
gtttttctctaatttattct

SEQ ID NO: 1187 - RNA, 20 nt, Artificial Sequence
  gRNA targeting domain - AsCpf1 RR HBG2 Promoter-11
gauucagucauuccaauuuu

SEQ ID NO: 1188 - DNA, 20 bp, Artificial Sequence
  gRNA targeting domain - AsCpf1 RR HBG2 Promoter-11
caagaggatactgctgctta

SEQ ID NO: 1189 - RNA, 20 nt, Artificial Sequence
  gRNA targeting domain - AsCpf1 RR HBG2 Promoter-12
auucagucauuccaauuuuu

SEQ ID NO: 1190 - DNA, 20 bp, Artificial Sequence
  gRNA targeting domain - AsCpf1 RR HBG2 Promoter-12
aagaggatactgctgcttaa

SEQ ID NO: 1191 - RNA, 20 nt, Artificial Sequence
  gRNA targeting domain - AsCpf1 RR HBG2 Promoter-13
gucauuccaauuuuucucua

SEQ ID NO: 1192 - DNA, 20 bp, Artificial Sequence
  gRNA targeting domain - AsCpf1 RR HBG2 Promoter-13
gattcagtcattccaatttt

SEQ ID NO: 1193 - RNA, 20 nt, Artificial Sequence
  gRNA targeting domain - AsCpf1 RR HBG2 Promoter-14
aauuuuucucuaauuuauuc

SEQ ID NO: 1194 - DNA, 20 bp, Artificial Sequence
  gRNA targeting domain - AsCpf1 RR HBG2 Promoter-14
attcagtcattccaattttt

SEQ ID NO: 1195 - RNA, 20 nt, Artificial Sequence
  gRNA targeting domain - AsCpf1 RR HBG2 Promoter-15
auuuuucucuaauuuauucu

SEQ ID NO: 1196 - DNA, 20 bp, Artificial Sequence
  gRNA targeting domain - AsCpf1 RR HBG2 Promoter-15
gtcattccaatttttctcta

SEQ ID NO: 1197 - RNA, 20 nt, Artificial Sequence
  gRNA targeting domain - AsCpf1 RR HBG2 Promoter-16
uucucccaucauagaggaua

SEQ ID NO: 1198 - DNA, 20 bp, Artificial Sequence
  gRNA targeting domain - AsCpf1 RR HBG2 Promoter-16
aatttttctctaatttattc

SEQ ID NO: 1199 - RNA, 20 nt, Artificial Sequence
  gRNA targeting domain - AsCpf1 RR HBG2 Promoter-17
aucauagaggauaccaggac

SEQ ID NO: 1200 - DNA, 20 bp, Artificial Sequence
  gRNA targeting domain - AsCpf1 RR HBG2 Promoter-17
atttttctctaatttattct

SEQ ID NO: 1201 - RNA, 20 nt, Artificial Sequence
  gRNA targeting domain - AsCpf1 RR HBG1 Promoter-18
accauagaagauaccaggac

SEQ ID NO: 1202 - DNA, 20 bp, Artificial Sequence
  gRNA targeting domain - AsCpf1 RR HBG1 Promoter-18
ttctcccatcatagaggata

SEQ ID NO: 1203 - RNA, 20 nt, Artificial Sequence
  gRNA targeting domain - AsCpf1 RR HBG1 Promoter-19
caguaccugccaaagaacau

SEQ ID NO: 1204 - DNA, 20 bp, Artificial Sequence
  gRNA targeting domain - AsCpf1 RR HBG1 Promoter-19
atcatagaggataccaggac

SEQ ID NO: 1205 - RNA, 20 nt, Artificial Sequence
  gRNA targeting domain - AsCpf1 RR HBG2 Promoter-20
uaguaucugguaaagagcau

SEQ ID NO: 1206 - DNA, 20 bp, Artificial Sequence
  gRNA targeting domain - AsCpf1 RR HBG2 Promoter-20
accatagaagataccaggac

SEQ ID NO: 1207 - RNA, 20 nt, Artificial Sequence
  gRNA targeting domain - AsCpf1 RR HBG1 Promoter-21
ucaaugcaaauaucugucug

SEQ ID NO: 1208 - DNA, 20 bp, Artificial Sequence
  gRNA targeting domain - AsCpf1 RR HBG1 Promoter-21
cagtacctgccaaagaacat

SEQ ID NO: 1209 - RNA, 20 nt, Artificial Sequence
  gRNA targeting domain - AsCpf1 RR HBG2 Promoter-22
cucuugggggccccuucccc

SEQ ID NO: 1210 - DNA, 20 bp, Artificial Sequence
  gRNA targeting domain - AsCpf1 RR HBG2 Promoter-22
tagtatctggtaaagagcat

SEQ ID NO: 1211 - RNA, 20 nt, Artificial Sequence
  gRNA targeting domain - AsCpf1 RVR HBG1 Promoter-1
gauucagucauuccaauuuu

SEQ ID NO: 1212 - DNA, 20 bp, Artificial Sequence
  gRNA targeting domain - AsCpf1 RVR HBG1 Promoter-1
tcaatgcaaatatctgtctg

SEQ ID NO: 1213 - RNA, 20 nt, Artificial Sequence
  gRNA targeting domain - AsCpf1 RVR HBG1 Promoter-2
auucagucauuccaauuuuu

SEQ ID NO: 1214 - DNA, 20 bp, Artificial Sequence
  gRNA targeting domain - AsCpf1 RVR HBG1 Promoter-2
ctcttgggggccccttcccc

SEQ ID NO: 1215 - RNA, 20 nt, Artificial Sequence
  gRNA targeting domain - AsCpf1 RVR HBG1 Promoter-3
aaaaaaauuagcaguauccu

SEQ ID NO: 1216 - DNA, 20 bp, Artificial Sequence
  gRNA targeting domain - AsCpf1 RVR HBG1 Promoter-3
aaaaaaattagcagtatcct

SEQ ID NO: 1217 - RNA, 20 nt, Artificial Sequence
  gRNA targeting domain - AsCpf1 RVR HBG1 Promoter-4
gccuuugccuuguuccgauu

SEQ ID NO: 1218 - DNA, 20 bp, Artificial Sequence
  gRNA targeting domain - AsCpf1 RVR HBG1 Promoter-4
gcctttgccttgttccgatt

SEQ ID NO: 1219 - RNA, 20 nt, Artificial Sequence
  gRNA targeting domain - AsCpf1 RVR HBG2 Promoter-5
aaaaaaauuaagcagcagua

SEQ ID NO: 1220 - DNA, 20 bp, Artificial Sequence
  gRNA targeting domain - AsCpf1 RVR HBG2 Promoter-5
aaaaaaattaagcagcagta

SEQ ID NO: 1221 - RNA, 20 nt, Artificial Sequence
  gRNA targeting domain - AsCpf1 RVR HBG1 Promoter-6
cucaguaaagaugaugguag

SEQ ID NO: 1222 - DNA, 20 bp, Artificial Sequence
  gRNA targeting domain - AsCpf1 RVR HBG1 Promoter-6
ctcagtaaagatgatggtag

SEQ ID NO: 1223 - RNA, 20 nt, Artificial Sequence
  gRNA targeting domain - AsCpf1 RVR HBG2 Promoter-7
acuggauaaguguaugugcu

SEQ ID NO: 1224 - DNA, 20 bp, Artificial Sequence
  gRNA targeting domain - AsCpf1 RVR HBG2 Promoter-7
actggataagtgtatgtgct

SEQ ID NO: 1225 - RNA, 20 nt, Artificial Sequence
  gRNA targeting domain - AsCpf1 RVR HBG2 Promoter-8
ugcuggcugaugacccaggg

SEQ ID NO: 1226 - DNA, 20 bp, Artificial Sequence
  gRNA targeting domain - AsCpf1 RVR HBG2 Promoter-8
tgctggctgatgacccaggg

SEQ ID NO: 1227 - RNA, 20 nt, Artificial Sequence
  gRNA targeting domain - AsCpf1 RVR HBG2 Promoter-9
cucgguaaagaugaugguag

SEQ ID NO: 1228 - DNA, 20 bp, Artificial Sequence
  gRNA targeting domain - AsCpf1 RVR HBG2 Promoter-9
ctcggtaaagatgatggtag

SEQ ID NO: 1229 - RNA, 20 nt, Artificial Sequence
  gRNA targeting domain - AsCpf1 RVR HBG2 Promoter-10
ugguaaagagcauucuacca

SEQ ID NO: 1230 - DNA, 20 bp, Artificial Sequence
  gRNA targeting domain - AsCpf1 RVR HBG2 Promoter-10
tggtaaagagcattctacca

SEQ ID NO: 1231 - RNA, 5 nt, Artificial Sequence
  +5 RNA gRNA 5' extension
cuuuu

SEQ ID NO: 1232 - RNA, 10 nt, Artificial Sequence
  +10 RNA gRNA 5' extension
aagaccuuuu

SEQ ID NO: 1233 - RNA, 25 nt, Artificial Sequence
  +25 RNA gRNA 5' extension
auguguuuuugucaaaagaccuuuu

SEQ ID NO: 1234 - RNA, 60 nt, Artificial Sequence
  +60 RNA gRNA 5' extension
aggccagcuugccgguuuuuuagucgugcugcuucauguguuuuugucaaaagaccuuuu

SEQ ID NO: 1235 - DNA, 5 bp, Artificial Sequence
  +5 DNA gRNA 5' extension
ctttt

SEQ ID NO: 1236 - DNA, 10 bp, Artificial Sequence
  +10 DNA gRNA 5' extension
aagacctttt

SEQ ID NO: 1237 - DNA, 25 bp, Artificial Sequence
  +25 DNA gRNA 5' extension
atgtgtttttgtcaaaagacctttt

SEQ ID NO: 1238 - DNA, 60 bp, Artificial Sequence
  +60 DNA gRNA 5' extension
aggccagcttgccggttttttagtcgtgctgcttcatgtgtttttgtcaaaagacctttt

SEQ ID NO: 1239 - DNA, 20 bp, Artificial Sequence
  +20 DNA gRNA 5' extension
tttttgtcaaaagacctttt

SEQ ID NO: 1240 - DNA, 30 bp, Artificial Sequence
  +30 DNA gRNA 5' extension
gcttcatgtgtttttgtcaaaagacctttt

SEQ ID NO: 1241 - DNA, 50 bp, Artificial Sequence
  +50 DNA gRNA 5' extension
gccggttttttagtcgtgctgcttcatgtgtttttgtcaaaagacctttt

SEQ ID NO: 1242 - DNA, 40 bp, Artificial Sequence
  +40 DNA gRNA 5' extension
tagtcgtgctgcttcatgtgtttttgtcaaaagacctttt

SEQ ID NO: 1243 - DNA, 20 bp, Artificial Sequence
  +20 DNA/2xPS gRNA 5' extension
  misc_feature (1)..(2): Linked by phosphorothioate (PS) bond
  misc_feature (2)..(3): Linked by phosphorothioate (PS) bond
ccgaagttttcttcggtttt

SEQ ID NO: 1244 - DNA, 25 bp, Artificial Sequence
  +25 DNA/2xPS gRNA 5' extension
  misc_feature (1)..(2): Linked by phosphorothioate (PS) bond
  misc_feature (2)..(3): Linked by phosphorothioate (PS) bond
tttttccgaagttttcttcggtttt

SEQ ID NO: 1245 - DNA, 30 bp, Artificial Sequence
  +30 DNA/2xPS gRNA 5' extension
  misc_feature (1)..(2): Linked by phosphorothioate (PS) bond
  misc_feature (2)..(3): Linked by phosphorothioate (PS) bond
aacgctttttccgaagttttcttcggtttt

SEQ ID NO: 1246 - DNA, 41 bp, Artificial Sequence
  +41 DNA/2xPS gRNA 5' extension
  misc_feature (1)..(2): Linked by phosphorothioate (PS) bond
  misc_feature (2)..(3): Linked by phosphorothioate (PS) bond
gcgttgttttcaacgctttttccgaagttttcttcggtttt

SEQ ID NO: 1247 - DNA, 62 bp, Artificial Sequence
  +62 DNA/2xPS gRNA 5' extension
  misc_feature (1)..(2): Linked by phosphorothioate (PS) bond
  misc_feature (2)..(3): Linked by phosphorothioate (PS) bond
ggcttcttttgaagcctttttgcgttgttttcaacgctttttccgaagttttcttcggtttt

SEQ ID NO: 1248 - DNA, 25 bp, Artificial Sequence
  +25 DNA/2xPS gRNA 5' extension
  misc_feature (1)..(2): Linked by phosphorothioate (PS) bond
  misc_feature (2)..(3): Linked by phosphorothioate (PS) bond
atgtgtttttgtcaaaagacctttt

SEQ ID NO: 1249 - DNA, 25 bp, Artificial Sequence
  +25 A gRNA 5' extension
aaaaaaaaaaaaaaaaaaaaaaaaa

SEQ ID NO: 1250 - DNA, 25 bp, Artificial Sequence
  +25 T gRNA 5' extension
ttttttttttttttttttttttttt

SEQ ID NO: 1251 - RNA, 25 nt, Artificial Sequence
  +25 RNA/2xPS gRNA 5' extension
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
auguguuuuugucaaaagaccuuuu

SEQ ID NO: 1252 - RNA, 25 nt, Artificial Sequence
  +25 polyA RNA/2xPS gRNA 5' extension
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
aaaaaaaaaaaaaaaaaaaaaaaaa

SEQ ID NO: 1253 - RNA, 25 nt, Artificial Sequence
  +25 polyU RNA/2xPS gRNA 5' extension
  misc_feature (1)..(2): Linked by phosphorothioate (PS) bond
  misc_feature (1)..(1): Modified to contain 2'-O-methyl
  misc_feature (2)..(2): Modified to contain 2'-O-methyl
  misc_feature (2)..(3): Linked by phosphorothioate (PS) bond
uuuuuuuuuuuuuuuuuuuuuuuuu

SEQ ID NO: 1254 - RNA, 21 nt, Artificial Sequence
  HBG1-1 21mer targeting domain
ccuugucaaggcuauugguca

SEQ ID NO: 1255 - DNA, 21 bp, Artificial Sequence
  HBG1-1 21mer targeting domain
ccttgtcaaggctattggtca

SEQ ID NO: 1256 - RNA, 22 nt, Artificial Sequence
  HBG1-1 22mer targeting domain
ccuugucaaggcuauuggucaa

SEQ ID NO: 1257 - DNA, 22 bp, Artificial Sequence
  HBG1-1 22mer targeting domain
ccttgtcaaggctattggtcaa

SEQ ID NO: 1258 - RNA, 23 nt, Artificial Sequence
  HBG1-1 23mer targeting domain
ccuugucaaggcuauuggucaag

SEQ ID NO: 1259 - DNA, 23 bp, Artificial Sequence
  HBG1-1 23mer targeting domain
ccttgtcaaggctattggtcaag

SEQ ID NO: 1260 - RNA, 21 nt, Artificial Sequence
  AsCpf1 HBG1 promoter-1 21mer targeting domain
agacagauauuugcauugaga

SEQ ID NO: 1261 - DNA, 21 bp, Artificial Sequence
  AsCpf1 HBG1 promoter-1 21mer targeting domain
agacagatatttgcattgaga

SEQ ID NO: 1262 - RNA, 21 nt, Artificial Sequence
  AsCpf1 HBG1 promoter-2 21mer targeting domain
cauugagauaguguggggaag

SEQ ID NO: 1263 - DNA, 21 bp, Artificial Sequence
  AsCpf1 HBG1 promoter-2 21mer targeting domain
cattgagatagtgtggggaag

SEQ ID NO: 1264 - RNA, 21 nt, Artificial Sequence
  AsCpf1 HBG1 promoter-6 21mer targeting domain
cuucucccaucauagaggaua

SEQ ID NO: 1265 - DNA, 21 bp, Artificial Sequence
  AsCpf1 HBG1 promoter-6 21mer targeting domain
cttctcccatcatagaggata

SEQ ID NO: 1266 - DNA, 125 bp, Artificial Sequence
  synthetic
gaggtctgccagtcctcttctaccccacccacgcccccaccctaatcagaggccaaacccttcctggagcctgtgataaaagcaactgttagcttgcactagactagcttcaaagttgtattgac

SEQ ID NO: 1267 - DNA, 82 bp, Artificial Sequence
  synthetic
gcctcactggatactctaagactattggtcaagtttgccttgtcaaggctattggtcaaggcaaggctggccaacccatggg

SEQ ID NO: 1268 - DNA, 82 bp, Artificial Sequence
  synthetic
cggagtgacctatgagattctgataaccagttcaaacggaacagttccgataaccagttccgttccgaccggttgggtaccc

SEQ ID NO: 1269 - DNA, 82 bp, Homo sapiens; identical to SEQ ID NO: 1267

SEQ ID NO: 1270 - DNA, 82 bp, Homo sapiens; identical to SEQ ID NO: 1268

The invention claimed is:

1. A ribonucleoprotein (RNP) complex comprising:
a Cpf1 variant comprising one or more modifications selected from the group consisting of one or more mutations in a wild-type Cpf1 amino acid sequence, one or more nuclear localization signals, one or more purification tags, and a combination thereof and
a gRNA comprising:
a 5' end and a 3' end,
a DNA extension at the 5' end, wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in a promoter of a gamma-globin (HBG) gene, wherein the target site comprises nucleotides located between Chr 11 (NC_000011.10) 5,249,955-5,249,987; Chr 11 (NC_000011.10) 5,254,879-5,254,909; or a combination thereof, and
an RNA segment capable of associating with the Cpf1 variant.

2. The RNP complex of claim 1, wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264.

3. The RNP complex of claim 2, wherein the Cpf1 variant comprises a sequence selected from the group consisting of SEQ ID NOs: 1000, 1001, 1008-1015, and 1035-39.

4. An ex vivo method of altering a promoter of a gamma-globin (HBG) gene in a cell comprising:
contacting the cell with an RNP complex comprising:
a Cpf1 variant comprising one or more modifications selected from the group consisting of one or more mutations in a wild-type Cpf1 amino acid sequence, one or more nuclear localization signals, one or more purification tags, and a combination thereof, and
a gRNA comprising:
a 5' end and a 3' end,
a DNA extension at the 5' end, wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in the promoter of the HBG gene, wherein the target site comprises nucleotides located between Chr 11 (NC_000011.10) 5,249,955-5,249,987; Chr 11 (NC_000011.10) 5,254,879-5,254,909: or a combination thereof, and
an RNA segment capable of associating with the Cpf1 variant.

5. The method of claim 4, wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264.

6. The method of claim 5, wherein the Cpf1 variant comprises a sequence selected from the group consisting of SEQ ID NOs: 1000, 1001, 1008-1015, and 1035-39.

7. The method of claim 5, wherein the cell is a CD34+ cell or a hematopoietic stem cell.

8. The method of claim 5, wherein the RNP complex is delivered to the cell using electroporation.

9. An ex vivo method of increasing a level of fetal hemoglobin (HbF) in a human cell by genome editing using an RNP complex, the method comprising:
contacting the human cell with the RNP complex comprising:
a Cpf1 variant comprising one or more modifications selected from the group consisting of one or more mutations in a wild-type Cpf1 amino acid sequence, one or more nuclear localization signals, one or more purification tags, and a combination thereof, and
a gRNA comprising:
a 5' end and a 3' end,
a DNA extension at the 5' end, wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in a promoter of a gamma-globin (HBG) gene, wherein the target site comprises nucleotides located between Chr 11 (NC_000011.10) 5,249,955-5,249,987; Chr 11 (NC_000011.10) 5,254,879-5,254,909; or a combination thereof, and
an RNA segment capable of associating with the Cpf1 variant to affect an alteration in the promoter of the HBG gene, thereby to increase expression of HbF.

10. The method of claim 9, wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264.

11. The method of claim 10, wherein the Cpf1 variant comprises a sequence selected from the group consisting of SEQ ID NOs: 1000, 1001, 1008-1015, and 1035-39.

12. The method of claim 10, wherein the human cell is a CD34+ cell or a hematopoietic stem cell.

13. The method of claim 10, wherein the RNP complex is delivered to the human cell using electroporation.

14. A method of alleviating one or more symptoms of sickle cell disease in a subject in need thereof, the method comprising:
a) isolating a population of CD34+ or hematopoietic stem cells from the subject,
b) modifying the population of isolated cells ex vivo by delivering an RNP complex to the population of isolated cells, thereby affecting an alteration in a promoter of a gamma-globin (HBG) gene in one or more isolated cells in the population, the RNP complex comprising:
a Cpf1 variant comprising one or more modifications selected from the group consisting of one or more mutations in a wild-type Cpf1 amino acid sequence, one or more nuclear localization signals, one or more purification tags, and a combination thereof, and a gRNA comprising:
a 5' end and a 3' end,
a DNA extension at the 5' end,
wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in the promoter of the HBG gene,
wherein the target site comprises nucleotides located between Chr 11 (NC_000011.10) 5,249,955-5,249,987; Chr 11 (NC_000011.10) 5,254,879-5,254,909; or a combination thereof, and c) administering the modified population of isolated cells to the subject, thereby alleviating one or more symptoms of sickle cell disease in the subject.

15. The method of claim 14, wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264.

16. The method of claim 15, wherein the Cpf1 variant comprises a sequence selected from the group consisting of SEQ ID NOs: 1000, 1001, 1008-1015, and 1035-39.

17. The method of claim 15, wherein the RNP complex is delivered to the cell using electroporation.

18. A ribonucleoprotein (RNP) complex comprising:
a Cpf1 variant comprising one or more modifications selected from the group consisting of one or more mutations in a wild-type Cpf1 amino acid sequence, one or more nuclear localization signals, one or more purification tags, and a combination thereof,
wherein the Cpf1 variant comprises a sequence selected from the group consisting of SEQ ID NOs: 1000, 1001, 1008-1015, and 1035-39, and
a gRNA comprising:
a 5' end and a 3' end,
a DNA extension at the 5' end,
wherein the DNA extension comprises a sequence selected from the group consisting of SEQ ID NOs: 1235-1250;
a 2'-O-methyl modification and a phosphorothioate modification at the 3' end,
a targeting domain that is complementary to a target site in a promoter of a gamma-globin (HBG) gene,
wherein the targeting domain comprises a sequence selected from the group consisting of SEQ ID NOs: 1002, 1004, 1139,1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264; and
an RNA segment capable of associating with the Cpf1 variant.

19. An ex vivo method of altering a promoter of a gamma-globin (HBG) gene in a cell comprising:
contacting the cell with an RNP complex comprising:
a Cpf1 variant comprising one or more modifications selected from the group consisting of one or more mutations in a wild-type Cpf1 amino acid sequence, one or more nuclear localization signals, one or more purification tags, and a combination thereof,
wherein the Cpf1 variant comprises a sequence selected from the group consisting of SEQ ID NOs: 1000, 1001, 1008-1015, and 1035-39, and
a gRNA comprising:
a 5' end and a 3' end,
a DNA extension at the 5' end,
wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in the promoter of the HBG gene,
wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264, and
an RNA segment capable of associating with the Cpf1 variant.

20. The method of claim 19, wherein the cell is a CD34+ cell or a hematopoietic stem cell.

21. The method of claim 19, wherein the RNP complex is delivered to the cell using electroporation.

22. An ex vivo method of increasing a level of fetal hemoglobin (HbF) in a human cell by genome editing using an RNP complex, the method comprising:
contacting the human cell with the RNP complex comprising:
a Cpf1 variant comprising one or more modifications selected from the group consisting of one or more mutations in a wild-type Cpf1 amino acid sequence, one or more nuclear localization signals, one or more purification tags, and a combination thereof,
wherein the Cpf1 variant comprises a sequence selected from the group consisting of SEQ ID NOs: 1000, 1001, 1008-1015, and 1035-39, and
a gRNA comprising:
a 5' end and a 3' end,
a DNA extension at the 5' end,
wherein the DNA extension comprises a sequence selected from the group consisting of SEQ ID NOs: 1235-1250,
a 2'-O-methyl modification and a phosphorothioate modification at the 3' end,
a targeting domain that is complementary to a target site in a promoter of a gamma-globin (HBG) gene,
wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175,1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264, and an RNA segment capable of associating with the Cpf1 variant to affect an alteration in the promoter of the HBG gene, thereby to increase expression of HbF.

23. The method of claim 22, wherein the human cell is a CD34+ cell or a hematopoietic stem cell.

24. The method of claim 22, wherein the RNP complex is delivered to the human cell using electroporation.

25. A method of alleviating one or more symptoms of sickle cell disease in a subject in need thereof, the method comprising:
   a) isolating a population of CD34+ or hematopoietic stem cells from the subject;
   b) modifying the population of isolated cells ex vivo by delivering an RNP complex to the population of isolated cells, thereby affecting an alteration in a promoter of a gamma-globin (HBG) gene in one or more isolated cells in the population, the RNP complex comprising:
      a Cpf1 variant comprising one or more modifications selected from the group consisting of one or more mutations in a wild-type Cpf1 amino acid sequence, one or more nuclear localization signals, one or more purification tags, and a combination thereof,
         wherein the Cpf1 variant comprises a sequence selected from the group consisting of SEQ ID NOs: 1000, 1001, 1008-1015, and 1035-39, and
      a gRNA comprising:
         a 5' end and a 3' end,
         a DNA extension at the 5' end, wherein the DNA extension comprises a sequence selected from the group consisting of SEQ ID NOs: 1235-1250,
         a 2'-O-methyl modification and a phosphorothioate modification at the 3' end,
         a targeting domain that is complementary to a target site in the promoter of the HBG gene,
            wherein the targeting domain comprises a sequence selected from the group consisting of SEQ ID NOs: 1002, 1004, 1139, 1141, 1143, 1145, 1147, 1149, 1151, 1153, 1155, 1157, 1159, 1161, 1163, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1254, 1256, 1258, 1260, 1262, and 1264,
      and
   c) administering the modified population of isolated cells to the subject, thereby alleviating one or more symptoms of sickle cell disease in the subject.

26. The method of claim 25, wherein the RNP complex is delivered to the cell using electroporation.

* * * * *